United States Patent
Ng et al.

(10) Patent No.: US 12,129,480 B2
(45) Date of Patent: *Oct. 29, 2024

(54) TARGETED INTEGRATION OF NUCLEIC ACIDS

(71) Applicant: GENENTECH, INC., South San Francisco, CA (US)

(72) Inventors: Chi Kin Domingos Ng, San Francisco, CA (US); Yongping Guo Crawford, Foster City, CA (US); Amy Shen, San Mateo, CA (US); Meixia Zhou, Foster City, CA (US); Bradley R. Snedecor, Portola Valley, CA (US); Shahram Misaghi, Oakland, CA (US); Albert Eric Gao, San Mateo, CA (US)

(73) Assignee: GENENTECH, INC., South San Francisco, CA (US)

( * ) Notice: Subject to any disclaimer, the term of this patent is extended or adjusted under 35 U.S.C. 154(b) by 1088 days.

This patent is subject to a terminal disclaimer.

(21) Appl. No.: 16/956,942

(22) PCT Filed: Dec. 21, 2018

(86) PCT No.: PCT/US2018/067070
§ 371 (c)(1),
(2) Date: Jun. 22, 2020

(87) PCT Pub. No.: WO2019/126634
PCT Pub. Date: Jun. 27, 2019

(65) Prior Publication Data
US 2021/0002669 A1    Jan. 7, 2021

Related U.S. Application Data

(60) Provisional application No. 62/711,272, filed on Jul. 27, 2018, provisional application No. 62/609,806, filed on Dec. 22, 2017.

(51) Int. Cl.
*C12N 15/90* (2006.01)
*C07K 16/00* (2006.01)

(52) U.S. Cl.
CPC ............ *C12N 15/907* (2013.01); *C07K 16/00* (2013.01); *C12N 15/90* (2013.01); *C07K 2317/51* (2013.01); *C07K 2317/515* (2013.01); *C12N 2800/30* (2013.01); *C12N 2800/90* (2013.01); *C12N 2840/00* (2013.01)

(58) Field of Classification Search
None
See application file for complete search history.

(56) References Cited

FOREIGN PATENT DOCUMENTS

| EP | 2 101 823 | 11/2016 | | |
|---|---|---|---|---|
| WO | WO 92/08796 | 5/1992 | | |
| WO | WO 94/28143 | 12/1994 | | |
| WO | WO 2004/106381 | 12/2004 | | |
| WO | WO 2005/061547 | 7/2005 | | |
| WO | WO 2007/042261 | 4/2007 | | |
| WO | WO 2008/119567 | 10/2008 | | |
| WO | WO 2013/026833 | 2/2013 | | |
| WO | WO 2013/026839 | 2/2013 | | |
| WO | WO 2014/121712 | 8/2014 | | |
| WO | WO 2014/205192 | 12/2014 | | |
| WO | WO-2014205192 A2 | * 12/2014 | ............ | C12N 15/63 |
| WO | WO 2015/148806 | 10/2015 | | |
| WO | WO 2016/020309 | 2/2016 | | |
| WO | WO 2017/184831 | 10/2017 | | |
| WO | WO 2017/184832 | 10/2017 | | |
| WO | WO-2017184832 A1 | * 10/2017 | ............ | C07K 16/00 |

OTHER PUBLICATIONS

Bacac, et al., "CEA TCB: A novel head-to-tail 2:1 T cell bispecific antibody for treatment of CEA-positive solid tumors," Oncoimmunology, vol. 5 No. 8 (2016).
Clackson, et al., "Making antibody fragments using phage display libraries," Nature, vol. 352: pp. 624-628 (1991).
Holliger and Hudson, "Engineered antibody fragments and the rise of single domains," Nature Biotechnology, vol. 23: pp. 1126-1136 (2005).
Holliger, et al., "Specific killing of lymphoma cells by cytotoxic T-cells mediated by a bispecific diabody," Protein Engineering, vol. 9, pp. 299-305 (1996).
International Search Report, mailed Jul. 16, 2019, for International Application No. PCT/US2018/067070.
Johnson, et al., "Effector Cell Recruitment with Novel Fv-based Dual-affinity Re-targeting Protein Leads to Potent Tumor Cytolysis and in Vivo B-cell Depletion," Journal of Molecular Biology, vol. 399, pp. 436-449 (2010).
Kindt et al., Kuby Immunology, 6th ed., W.H. Freeman and Co., p. 91 (2007).
Kipriyanov, et al., "Bispecific tandem diabody for tumor therapy with improved antigen binding and pharmacokinetics," Journal of Molecular Biology, vol. 293, pp. 41-56 (1999).
Nagorsen and Baeuerle, "Immunomodulatory therapy of cancer with T cell-engaging BiTE antibody blinatumomab," Experimental Cell Research, vol. 317, pp. 1255-1260 (2011).
Portolano, et al., "Lack of promiscuity in autoantigen-specific H and L chain combinations as revealed by human H and L chain 'roulette'," J. Immunol., vol. 150: pp. 880-887 (1993).
Seimetz, et al., "Development and approval of the trifunctional antibody catumaxomab (anti-EpCAM × anti-CD3) as a targeted cancer immunotherapy," Cancer Treatment Reviews, vol. 36, pp. 458-467 (2010).
Stadler, et al., "Elimination of large tumors in mice by mRNA-encoded bispecific antibodies," Nature Medicine, vol. 23, pp. 815-817 (2017), published online 2017.

* cited by examiner

*Primary Examiner* — Celine X Qian
*Assistant Examiner* — Tiffany Nicole Grooms
(74) *Attorney, Agent, or Firm* — Baker Botts L.L.P.

(57) ABSTRACT

The presently disclosed subject matter relates to targeted integration (TI) host cells suitable for the expression of recombinant proteins, as well as methods of producing and using said TI host cells.

84 Claims, 41 Drawing Sheets

Specification includes a Sequence Listing.

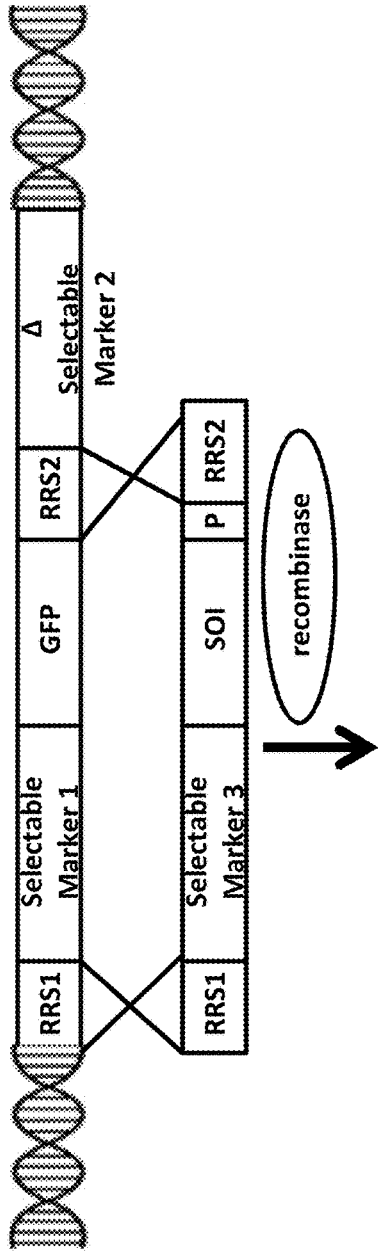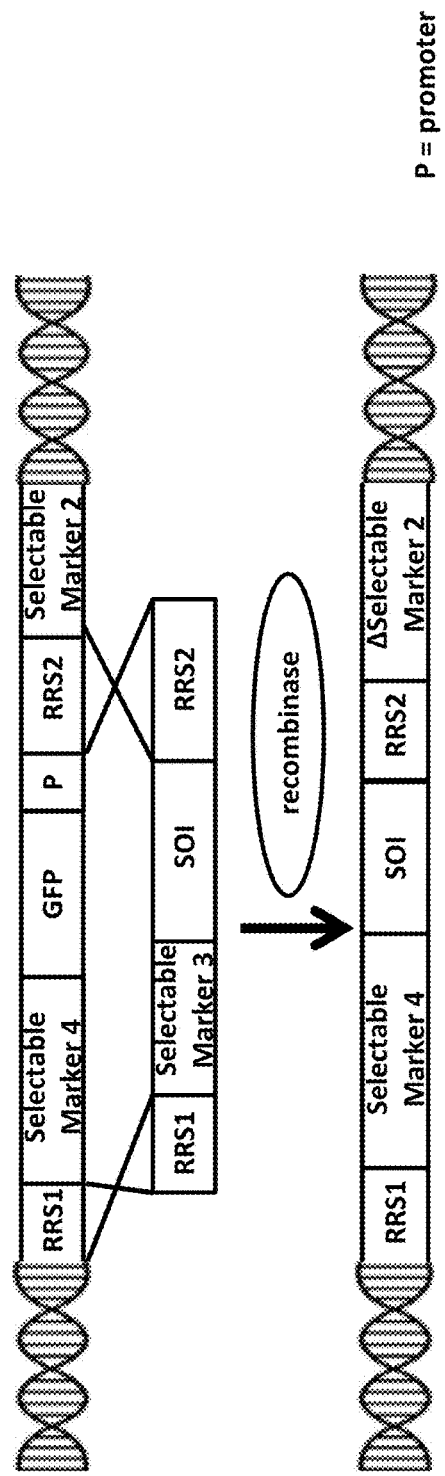
FIG. 2A
FIG. 2B

| Molecule | # of Cell line developments | cell lines screened | Titers observed |
|---|---|---|---|
| mAb-I (Difficult to express molecule) | 4 attempts | 120+ | Below 50% of typical range |
| mAB-II (Average expressing molecule) | 1 attempt | 24 | Typical range (>2g/L) |

FIG. 9A

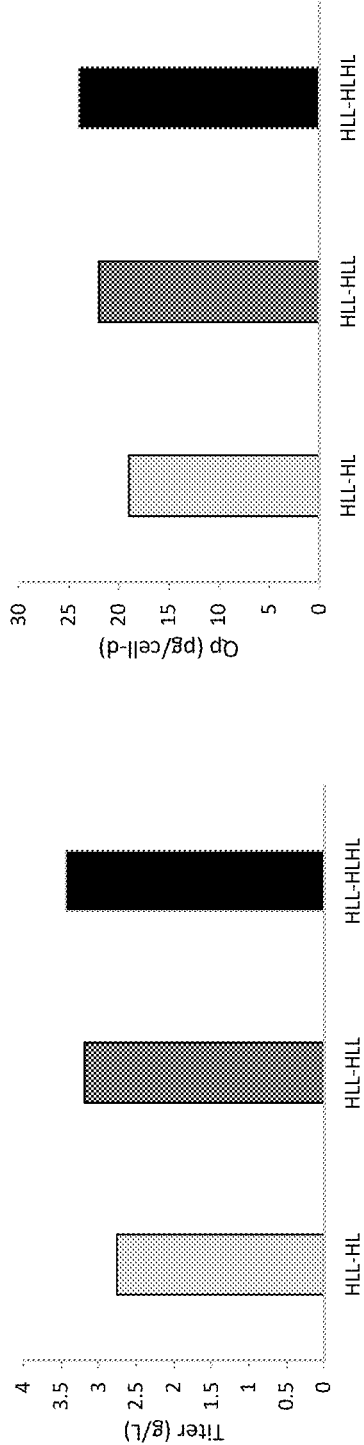
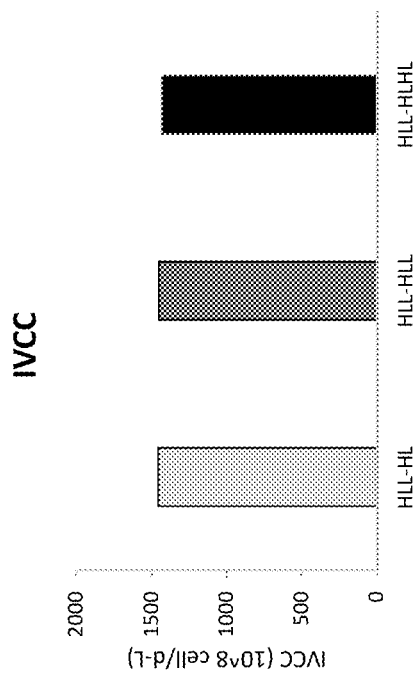
FIG. 19A
FIG. 19B
FIG. 19C

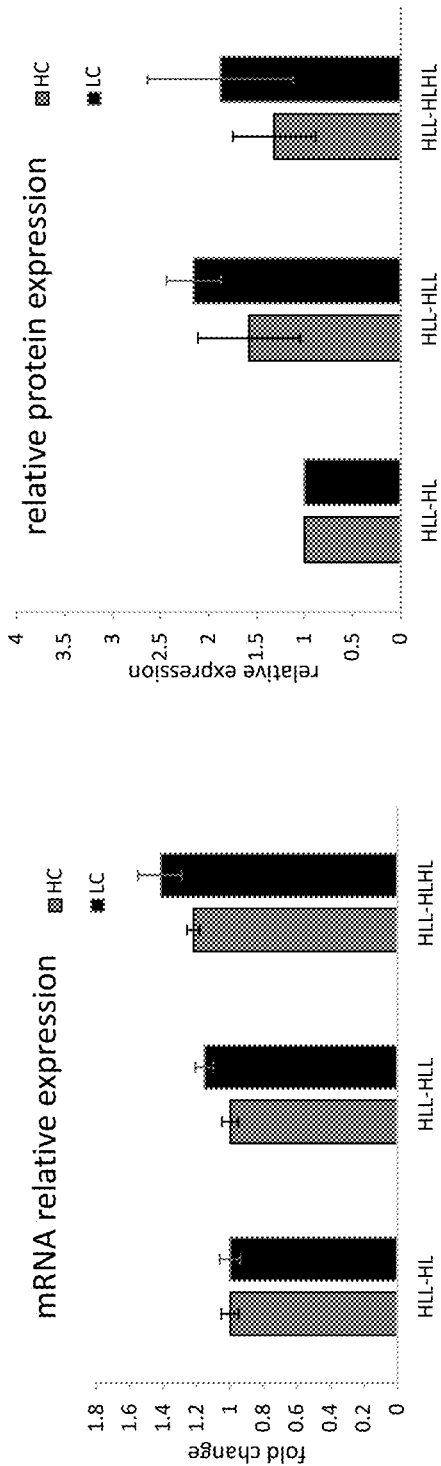
FIG. 19D
FIG. 19E
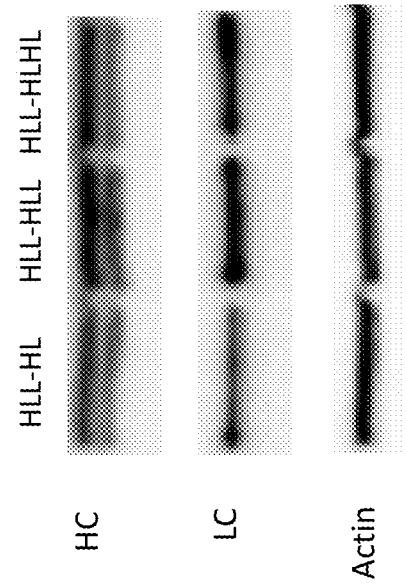
FIG. 19F

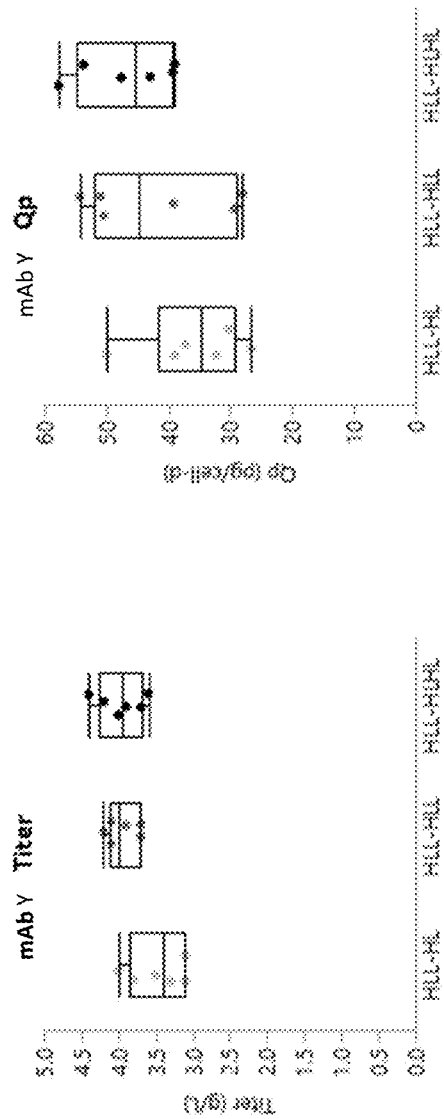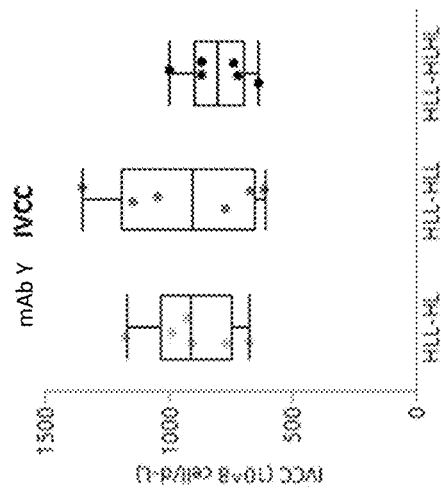
FIG. 20A
FIG. 20B
FIG. 20C

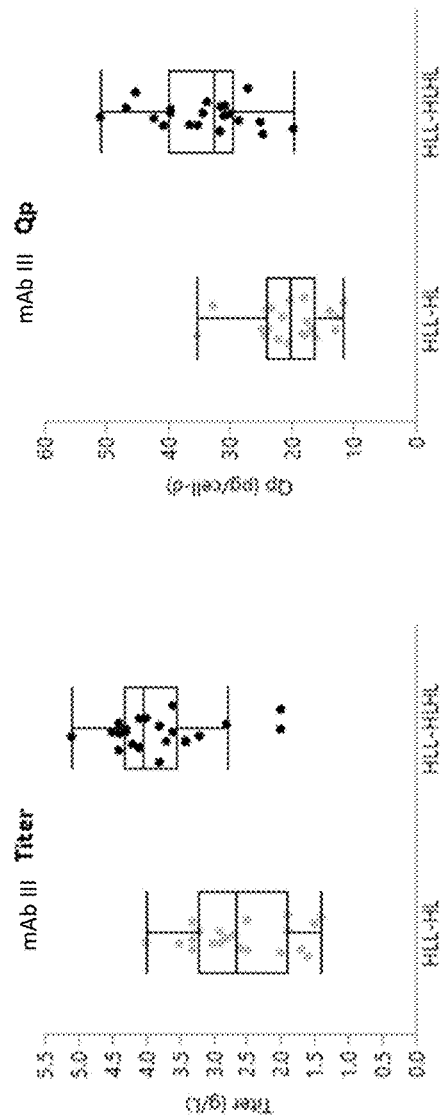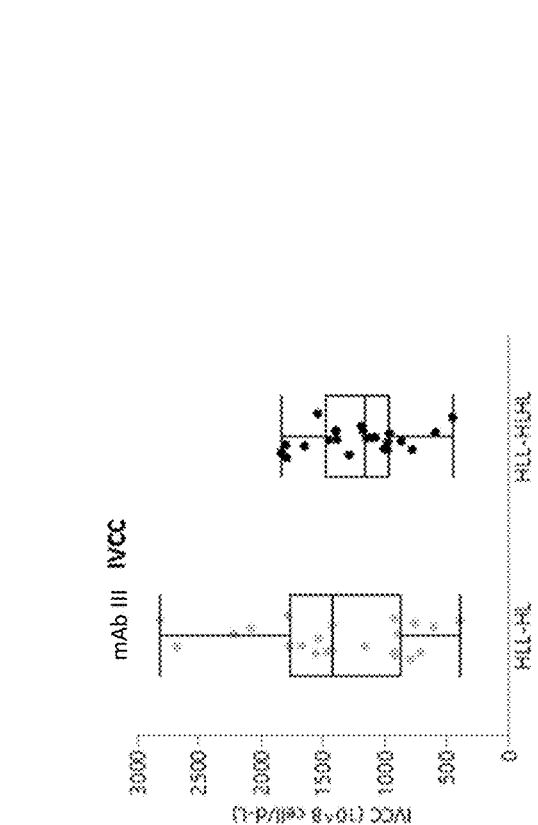
FIG. 20D
FIG. 20E
FIG. 20F

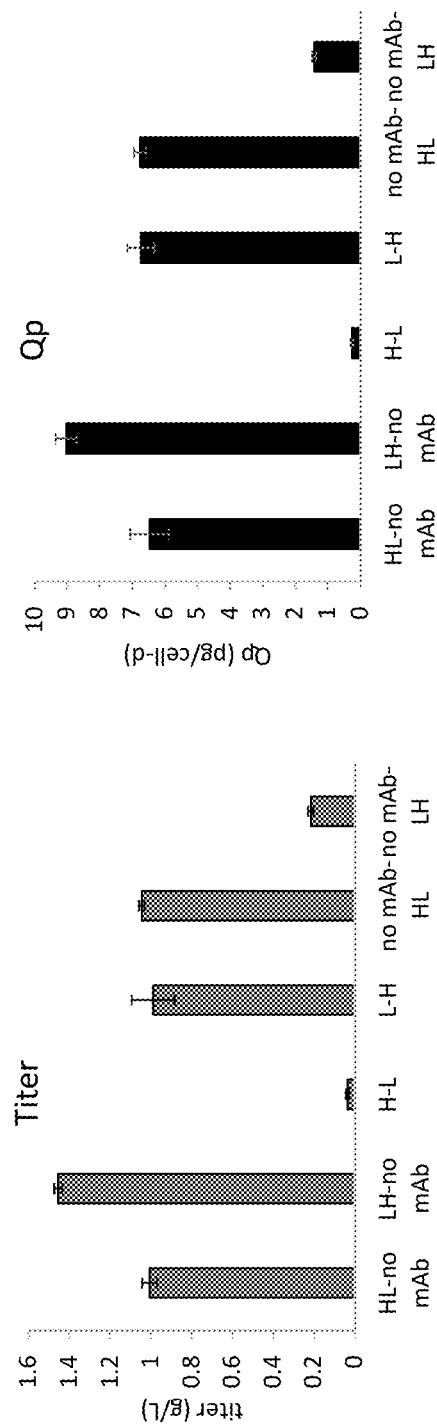
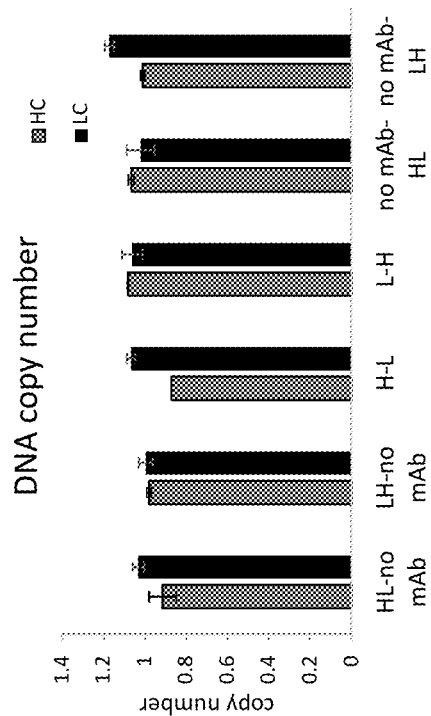
FIG. 21C
FIG. 21D
FIG. 21E

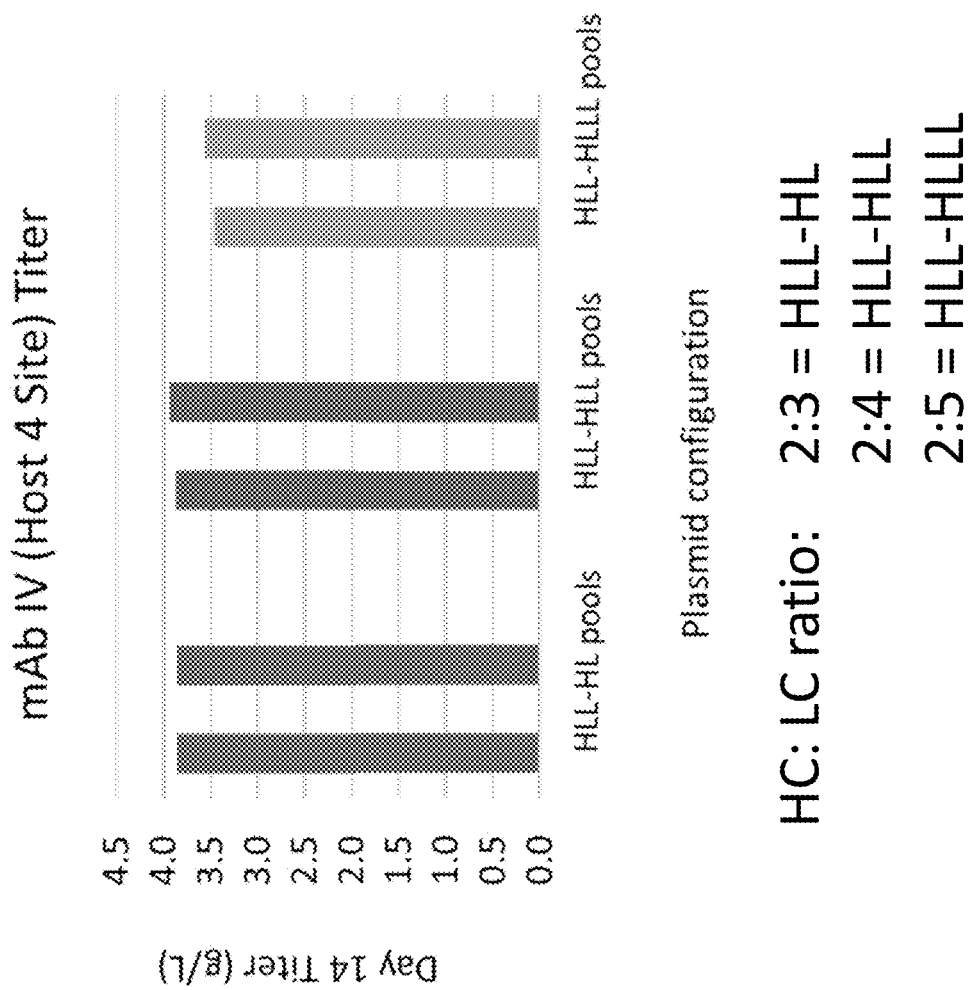

TARGETED INTEGRATION OF NUCLEIC ACIDS

CROSS REFERENCE TO RELATED APPLICATIONS

This application is a U.S. National Stage Patent Application under 35 U.S.C. § 371 of International Application No. PCT/US2018/067070, filed on Dec. 21, 2018, which claims the benefit of U.S. Provisional Application No. 62/609,806, filed Dec. 22, 2017, and U.S. Provisional Application No. 62/711,272, filed Jul. 27, 2018, the disclosures of each of which are incorporated herein by reference in their entireties.

TECHNICAL FIELD

The presently disclosed subject matter relates to targeted integration (TI) host cells suitable for the expression of recombinant proteins, as well as methods of producing and using said TI host cells.

SEQUENCE LISTING

The present specification makes reference to a Sequence Listing (submitted electronically as a TXT file named "00B2060920.txt" on Aug. 29, 2024). The 00B2060920.txt file was generated on Aug. 29, 2024 and is 9,734,109 bytes in size. The entire contents of the Sequence Listing are hereby incorporated by reference.

BACKGROUND

Due to the rapid advancement in cell biology and immunology, there has been an increasing demand to develop novel therapeutic recombinant proteins for a variety of diseases including cancer, cardiovascular diseases and metabolic diseases. These biopharmaceutical candidates are commonly manufactured by commercial cell lines capable of expressing the proteins of interest. For example, Chinese hamster ovary (CHO) cells have been widely adapted to produce monoclonal antibodies.

The conventional strategy for developing a commercial cell line involves the random integration of a nucleotide sequence encoding the polypeptide of interest followed by selection and isolation of cell lines producing the polypeptide of interest. This approach, however, has several disadvantages. First, such integration is not only a rare event but, given the randomness as to where the nucleotide sequence integrates, these rare events can result in a variety of gene expression and cell growth phenotypes. Such variation, known as "position effect variation," originates, at least in part, from the complex gene regulatory networks present in eukaryotic cell genomes and the accessibility of certain genomic loci for integration and gene expression. Second, random integration strategies generally do not offer control over the number of gene copies integrated into a host cell genome. In fact, gene amplification methods are often used to achieve high-producing cells. Such gene amplification, however, can lead to unwanted cell phenotypes such as unstable cell growth and/or product expression. Third, because of the integration loci heterogeneity inherent in the random integration process, it is time-consuming and labor-intensive to screen thousands of clones after transfection to isolate cell lines demonstrating a desirable level of expression of the polypeptides of interest. Even after isolating such cell lines, stable expression of the polypeptide of interest is not guaranteed and further screening may be required to obtain a stable commercial cell line. Finally, polypeptides produced from randomly integrated cell lines exhibit a high degree of sequence variance, which may be, in part, due to the mutagenicity of the selective agents used to select for a high level of expression of polypeptides of interest.

SUMMARY OF THE INVENTION

The presently disclosed subject matter relates to targeted integration (TI) host cells suitable for the expression of recombinant proteins. The presently disclosed subject matter not only provides host cell TI sites that have high productivity, it also provides a novel method of introducing multiple sequences of interest into a single TI locus in a host cell by recombinase-mediated cassette exchange (RMCE). The advantages of the RMCE method include increased productivity and the flexibility to co-express multiple polypeptides in varying ratios from the same TI locus. For example, but not by way of limitation, the RMCE strategies disclosed herein allow for the insertion of one, two, three, four, five, six, seven, eight or more sequences (e.g., antibody heavy chain (HC) or light chain (LC) sequences) to the TI locus. With the ability to target eight or more sequences simultaneously, the two-plasmid RMCE enables modulation of HC and LC chain ratios of mAb to improve productivity, expression of complex molecules with multiple chains, and targeting of transgenes, endogenous genes or RNAi with the antibody to modify cellular pathways.

In certain embodiments, a TI host cell comprises an exogenous nucleotide sequence integrated at an integration site within a locus of the genome of the host cell, wherein the locus is at least about 90% homologous to a sequence selected from SEQ ID Nos. 1-7. In certain embodiments, the nucleotide sequence immediately 5' of the integrated exogenous nucleotide sequence is selected from the group consisting of sequences at least about 90% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1. In certain embodiments, the nucleotide sequence immediately 3' of the integrated exogenous nucleotide sequence is selected from the group consisting of sequences at least about 90% homologous to nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1. In certain embodiments, the integrated exogenous nucleotide sequence is operably linked to a nucleotide sequence selected from the group consisting of sequences at least about 90% homologous to a sequence selected from SEQ ID Nos. 1-7.

In certain embodiments, a TI host cell comprises an exogenous nucleotide sequence integrated at an integration site within an endogenous gene selected from the group consisting of LOC107977062 (SEQ ID NO. 1), LOC100768845 (SEQ ID NO. 2), ITPR2 (SEQ ID NO. 3), ERE67000.1 (SEQ ID NO. 4), UBAP2 (SEQ ID NO. 5), MTMR2 (SEQ ID NO. 6), XP_003512331.2 (SEQ ID NO. 7), and sequences at least about 90% homologous thereto. In certain embodiments, the exogenous nucleotide sequence is integrated at an integration site operably linked to an endogenous gene selected from the group consisting of LOC107977062 (SEQ ID NO. 1), LOC100768845 (SEQ ID NO. 2), ITPR2 (SEQ ID NO. 3), ERE67000.1 (SEQ ID NO. 4), UBAP2 (SEQ ID NO. 5), MTMR2 (SEQ ID NO. 6), XP_003512331.2 (SEQ ID NO. 7), and sequences at least about 90% homologous thereto. In certain embodiments, the integrated exogenous nucleotide is flanked by a nucleotide sequence selected from the group consisting of sequences at least about 90% homologous to a sequence selected from SEQ ID Nos. 1-7. In certain embodiments, the exogenous nucleotide sequence is integrated at an integration site immediately adjacent to all or a portion of a sequence selected from the group consisting of sequences at least about 90% homologous to a sequence selected from SEQ ID Nos. 1-7.

In certain embodiments, a TI host cell is a mammalian host cell. In certain embodiments, a TI host cell is a hamster host cell, a human host cell, a rat host cell, or a mouse host cell. In certain embodiments, a TI host cell is a Chinese hamster ovary (CHO) host cell, a CHO K1 host cell, a CHO K1SV host cell, a DG44 host cell, a DUKXB-11 host cell, a CHOK1S host cell, or a CHO KIM host cell.

In certain embodiments, a TI host cell comprises an integrated exogenous nucleotide sequence, wherein the exogenous nucleotide sequence comprises one or more recombination recognition sequence (RRS). In certain embodiments, the exogenous nucleotide sequence comprises at least two RRSs. The RRS can be recognized by a recombinase, for example, a Cre recombinase, an FLP recombinase, a Bxb1 integrase, or a φC31 integrase. The RRS can be selected from the group consisting of a LoxP sequence, a LoxP L3 sequence, a LoxP 2 L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a φC31 attP sequence, and a φC31 attB sequence.

In certain embodiments, the exogenous nucleotide sequence comprises a first and a second RRS, and at least one selection marker located between the first and the second RRS. In certain embodiments, the exogenous nucleotide sequence further comprises a third RRS, wherein the third RRS is located between the first and the second RRS, and the third RRS is different from the first or the second RRS. In certain embodiments, the exogenous nucleotide sequence comprises a first and a second RRS, and a first selection marker located between the first and the second RRS. In certain embodiments, the exogenous nucleotide sequence further comprises a second selection marker, and the first and the second selection markers are different. In certain embodiments, the exogenous nucleotide sequence can further comprise a third selection marker and an internal ribosome entry site (IRES), wherein the IRES is operably linked to the third selection marker. The third selection marker can be different from the first or the second selection marker. The selection markers can be selected from the group consisting of an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid. The selection markers can also be selected from the group consisting of a green fluorescent protein (GFP) marker, an enhanced GFP (eGFP) marker, a synthetic GFP marker, a yellow fluorescent protein (YFP) marker, an enhanced YFP (eYFP) marker, a cyan fluorescent protein (CFP) marker, an mPlum marker, an mCherry marker, a tdTomato marker, an mStrawberry marker, a J-red marker, a DsRed-monomer marker, an mOrange marker, an mKO marker, an mCitrine marker, a Venus marker, a YPet marker, an Emerald6 marker, a CyPet marker, an mCFPm marker, a Cerulean marker, and a T-Sapphire marker. In some embodiments, the selection marker is selected from the group consisting of a green fluorescent protein (GFP) marker, an enhanced GFP (eGFP) marker, a synthetic GFP marker.

In certain embodiments, the exogenous nucleotide sequence comprises at least one selection marker and at least one exogenous sequence of interest (SOI). In certain embodiments, the exogenous nucleotide sequence comprises a first and a second RRS, and at least one selection marker and at least one exogenous SOI located between the first and the second RRS. In certain embodiments, the exogenous nucleotide sequence comprises a first, second, and third RRS, at least one selection marker and at least one exogenous SOI located between the first and the third RRS, and at least one exogenous SOI located between the third and the second RRS. The sequence of interest can encode any polypeptide of interest, including but not limited to the examples listed herein. The SOIs can be the same or they can be different, for example the SOIs can include coding sequences to both chains of an antibody. In the case where two or more different polypeptides are expressed, the sequence of interest can include the two polypeptides at various ratios, e.g., when eight coding sequences encode two different polypeptides including, but not limited to, 1:7, 2:6, etc. The SOIs can encode a single chain antibody, an antibody light chain, an antibody heavy chain, a single-chain Fv fragment (scFv), or an Fc fusion protein.

The presently disclosed subject matter also provides methods for the targeted integration of an exogenous nucleic acid into a host cell to facilitate the expression of a polypeptide of interest. In certain embodiments, such methods comprise the targeted integration of an exogenous nucleic acid into a host cell via recombinase-mediated recombination. In certain embodiments, such methods relate to a cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and sequences least about 90% homologous thereto. In certain embodiments, such methods relate to a cell comprising an exogenous nucleotide sequence integrated within a locus of the genome of the host cell, wherein the locus comprises a nucleotide sequence that is at least about 90% homologous to a sequence selected from SEQ ID Nos. 1-7.

In certain embodiments, the present disclosure provides a method of preparing a TI host cell expressing a polypeptide of interest comprises: a) providing a TI host cell comprising an exogenous nucleotide sequence integrated at a site within a locus of the genome of the TI host cell, wherein the locus is at least about 90% homologous to a sequence selected from SEQ ID Nos. 1-7, wherein the exogenous nucleotide sequence comprises two RRSs, flanking at least one first selection marker; b) introducing into the cell provided in a) a vector comprising two RRSs matching the two RRSs on the integrated exogenous nucleotide sequence and flanking at least one exogenous SOI and at least one second selection marker; c) introducing a recombinase, wherein the recombinase recognizes the RRSs; and d) selecting for TI cells expressing the second selection marker to thereby isolate a TI host cell expressing the polypeptide of interest.

In certain embodiments, the present disclosure provides a method of preparing a TI host cell expressing a first and second polypeptide of interest (where the first and second polypeptides can be the same or different) comprises: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first and a second RRS flanking at least one first selection marker, and a third RRS located between the first and the second RRS, wherein the first, second, and third RRSs are hetero-specific, i.e., the first, second, and third RRSs are not matched RRSs and therefore any two of the first, second, and third RRSs would not be amenable to recombinase-mediated recombination; b) introducing into the cell provided in a) a first vector comprising two RRSs matching the first and the third RRS on the integrated exogenous nucleotide sequence and flanking at least one first exogenous SOI and at least one second selection marker; c) introducing into the cell provided in a) a second vector comprising two RRSs matching the second and the third RRS on the integrated exogenous nucleotide sequence and flanking at least one second exogenous SOI; d) introducing one or more recombinases, wherein the one or more recombinases recognize the RRSs; and e) selecting for TI cells expressing the second selection marker to thereby isolate a TI host cell expressing the first and second polypeptides of interest.

In certain embodiments, the present disclosure provides a method for expressing a polypeptide of interest comprises: a) providing a host cell comprising at least one exogenous SOI and at least one selection marker flanked by two RRSs integrated within a locus of the genome of the host cell, wherein the locus is at least about 90% homologous to a sequence selected from SEQ ID Nos. 1-7; and b) culturing the cell in a) under conditions suitable for expressing the SOI and recovering a polypeptide of interest therefrom.

In certain embodiments, the present disclosure provides a method for expressing a polypeptide of interest comprises: a) providing a host cell comprising at least two exogenous SOIs and at least one selection marker integrated within a locus of the genome of the host cell, wherein the locus is at least about 90% homologous to a sequence selected from SEQ ID Nos. 1-7, wherein at least one exogenous SOI and one selection marker is flanked by a first and a third RRS and at least one exogenous SOI is flanked by a second and the third RRS; and b) culturing the cell in a) under conditions suitable for expressing the SOI and recovering a polypeptide of interest therefrom.

The presently disclosed subject matter also provides compositions and methods to produce polypeptides of interest via the use of TI host cells. Such compositions and methods include, but are not limited to, polynucleotides and vectors, facilitating the integration of an exogenous nucleotide sequence into a TI host cell as well as TI host cells and compositions comprising exogenous nucleotide sequences and methods of using the same. In certain embodiments, a vector can comprise nucleotide sequences at least 50% homologous to a sequence selected from SEQ ID Nos. 1-7 flanking a DNA cassette, wherein the DNA cassette comprises at least one selection marker and at least one exogenous SOI flanked by two RRSs. The vector can be selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid.

In certain embodiments, the methods of the present disclosure comprise the targeted integration of an exogenous nucleic acid encoding a polypeptide of interest into a host cell via homologous recombination, homology-directed repair (HDR), and/or non-homologous end joining (NHEJ). In certain embodiments, such methods involve the integration of an exogenous nucleic acid encoding a polypeptide of interest into a cell at a site within an endogenous gene selected from the group consisting of LOC107977062 (SEQ ID NO. 1), LOC100768845 (SEQ ID NO. 2), ITPR2 (SEQ ID NO. 3), ERE67000.1 (SEQ ID NO. 4), UBAP2 (SEQ ID NO. 5), MTMR2 (SEQ ID NO. 6), XP_003512331.2 (SEQ ID NO. 7), and sequences at least about 90% homologous thereto. In certain embodiments, such methods involve the integration of an exogenous nucleic acid encoding a polypeptide of interest into a cell at a site within a locus of the genome of the host cell, wherein the locus comprises a nucleotide sequence that is at least about 90% homologous to a sequence selected from SEQ ID Nos. 1-7.

In certain embodiments, the present disclosure provides a method for preparing a TI host cell expressing a polypeptide of interest comprises: a) providing a host cell comprising a locus of the genome of the host cell, wherein the locus is at least about 90% homologous to a sequence selected from SEQ ID Nos. 1-7; b) introducing a vector into the host cell, wherein the vector comprises nucleotide sequences at least 50% homologous to a sequence selected from SEQ ID Nos. 1-7 flanking a DNA cassette, wherein the DNA cassette comprises at least one selection marker and at least one exogenous SOI flanked by two RRSs; and c) selecting for the selection marker to isolate a TI host cell with the SOI integrated in the locus of the genome, and expressing the polypeptide of interest. In certain embodiments, such methods involve the use of an exogenous nuclease to promote the targeted integration. The exogenous nuclease can be selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

In certain embodiments, the present disclosure provides a method of preparing a TI host cell expressing a polypeptide of interest comprising: a) providing a TI host cell comprising at least one exogenous nucleotide sequence integrated at a site within one or more loci of the genome of the TI host cell, wherein the one or more loci are at least about 90% homologous to a sequence selected from SEQ ID No. 1-7, wherein the exogenous nucleotide sequence comprises one or more RRSs; b) introducing into the cell provided in a) a vector comprising one or more RRSs matching the one or more RRSs on the integrated exogenous nucleotide sequence and flanking at least one exogenous SOI operably linked to a regulatable promoter; c) introducing a recombinase or a nucleic acid encoding a recombinase, wherein the recombinase recognizes the RRSs; and d) selecting for TI cells expressing the exogenous SOI in the presence of an inducer to thereby isolate a TI host cell expressing the polypeptide of interest.

In certain embodiments, the present disclosure provides a method for expressing a polypeptide of interest comprising: a) providing a host cell comprising at least one exogenous SOI flanked by two RRSs and operably linked to a regulatable promoter integrated within a locus of the genome of the host cell, wherein the locus is at least about 90% homologous to a sequence selected from SEQ ID Nos. 1-7; and b) culturing the cell under conditions suitable for expressing the SOI and recovering a polypeptide of interest therefrom.

In certain embodiments, the present disclosure provides a method for preparing a TI host cell expressing a first and second polypeptide of interest (where the first and second polypeptides can be the same or different) comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first, second RRS and a third RRS located between the first and the second RRS, wherein the first, second, and third RRSs are heterospecific, i.e. the first, second, and third RRSs are not matched RRSs and therefore any two of the first, second, and third RRSs would not be amenable to recombinase-mediated recombination; b) introducing into the cell provided in a) a first vector comprising two RRSs matching the first and the third RRS on the integrated exogenous nucleotide sequence and flanking at least one first exogenous SOI operably linked to a regulatable promoter; c) introducing into the cell provided in a) a second vector comprising two RRSs matching the second and the third RRS on the integrated exogenous nucleotide sequence and flanking at least one second exogenous SOI operably linked to a regulatable promoter; d) introducing one or more recombinases, or one or more nucleic acids encoding one or more recombinases, wherein the one or more recombinases recognize the RRSs; and e) selecting for TI cells expressing the exogenous SOI in the presence of an inducer to thereby isolate a TI host cell expressing the first and second polypeptides of interest.

BRIEF DESCRIPTION OF THE DRAWINGS

FIGS. 2A and 2B depict two double selection schemes which were utilized to generate the targeted antibody expressing population. Transposase generated TI hosts are depicted in FIG. 2A and random integration generated TI hosts are depicted in FIG. 2B.

Figure 18B:
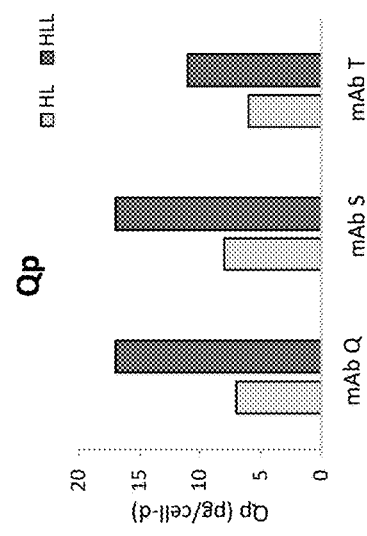
FIGS. 18 A to D depict the titer and specific productivity results for RMCE pools of three mAbs. Day 14 titer for RMCE pools of three mAbs comparing the HL and HLL configurations is depicted in FIG. 18A. Day 14 specific productivity (Qp) for RMCE pools of three mAbs comparing the HL and HLL configurations is depicted in FIG. 18B.
Figure 18D:
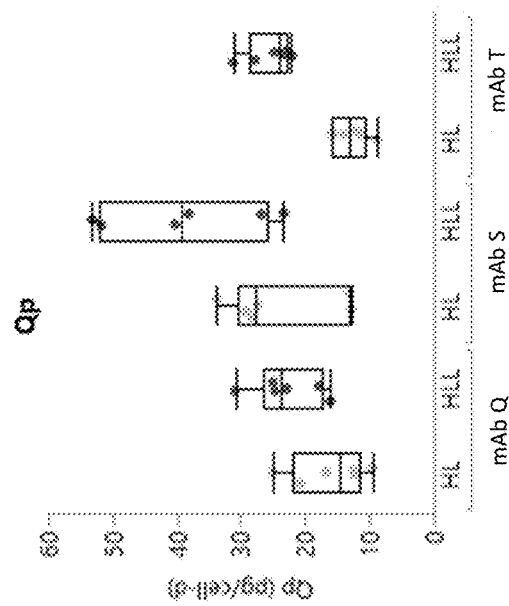
Figure 18A:
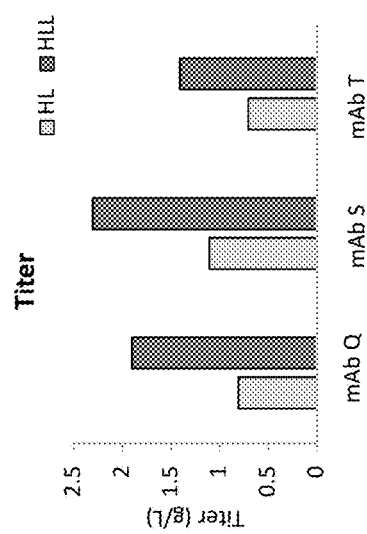
Figure 18C:
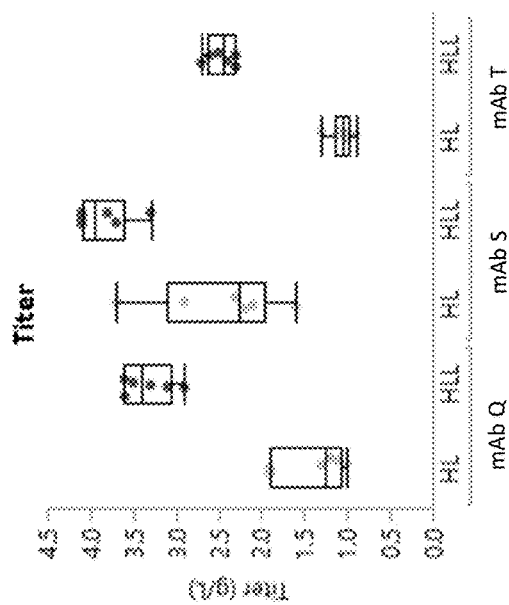

Day 14 titer for clones generated from the pools of FIG. 18A are depicted in FIG. 18C. Day 14 Qp for clones generated from the pools of FIG. 18A are depicted in FIG. 18D. For FIGS. 18C and D six clones per configuration were tested.

FIGS. 19 A to F depict titer, Qp, and growth (as expressed by the integral of viable cell concentration, IVCC), mRNA expression and protein expression for RMCE pools of mAb Y comparing three different plasmid configurations. Day 14 titer, Qp, and growth (as expressed by the integral of viable cell concentration, IVCC) are depicted in FIGS. 19 A, B and C respectively. Each bar represents data from a single pool. Seed train mRNA expression and intracellular antibody protein expression from the pools in 19A. mRNA expression for heavy and light chain was normalized to the HLL-HL configuration; each bar the average of four technical replicates (error bars are standard deviation) mRNA expression for heavy and light chain was normalized to the HLL-HL configuration. Intracellular heavy and light chain protein expression from all pools quantified from western blots and normalized to the HLL-HL configuration, is depicted in FIG. 19E; each bar is the average of three technical replicates (error bars are standard deviation). A representative western blot image of the data shown in FIG. 19E is depicted in FIG. 19F.

FIGS. 20 A to F depict titer, Qp, and growth (as expressed by the integral of viable cell concentration, IVCC) for mAb Y or mAb III expressing monoclones generated from RMCE pools with three different configurations. Day 14 titer for mAb Y expressing monoclones is depicted in FIG. 20A. Day 14 Qp for mAb Y expressing monoclones is depicted in FIG. 20B. Day 14 IVCC for mAb Y expressing clones is depicted in FIG. 20C. Day 14 titer for mAb III expressing monoclones is depicted in FIG. 20D. Day 14 Qp for mAb III expressing monoclones is depicted in FIG. 20E. Day 14 IVCC for mAb III expressing clones is depicted in FIG. 20F.

Figure 21A:
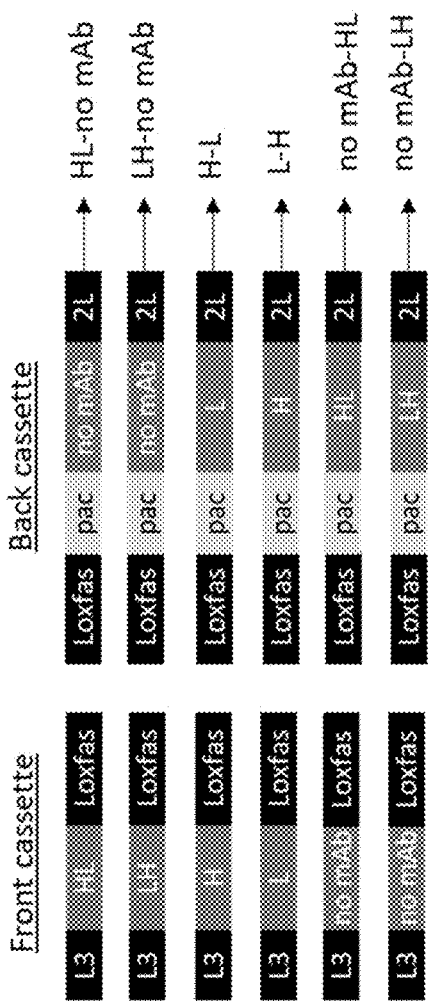
Figure 21B:
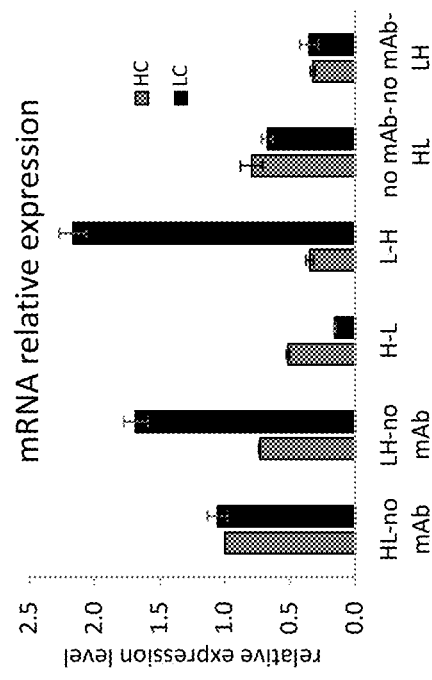
Figure 23B:
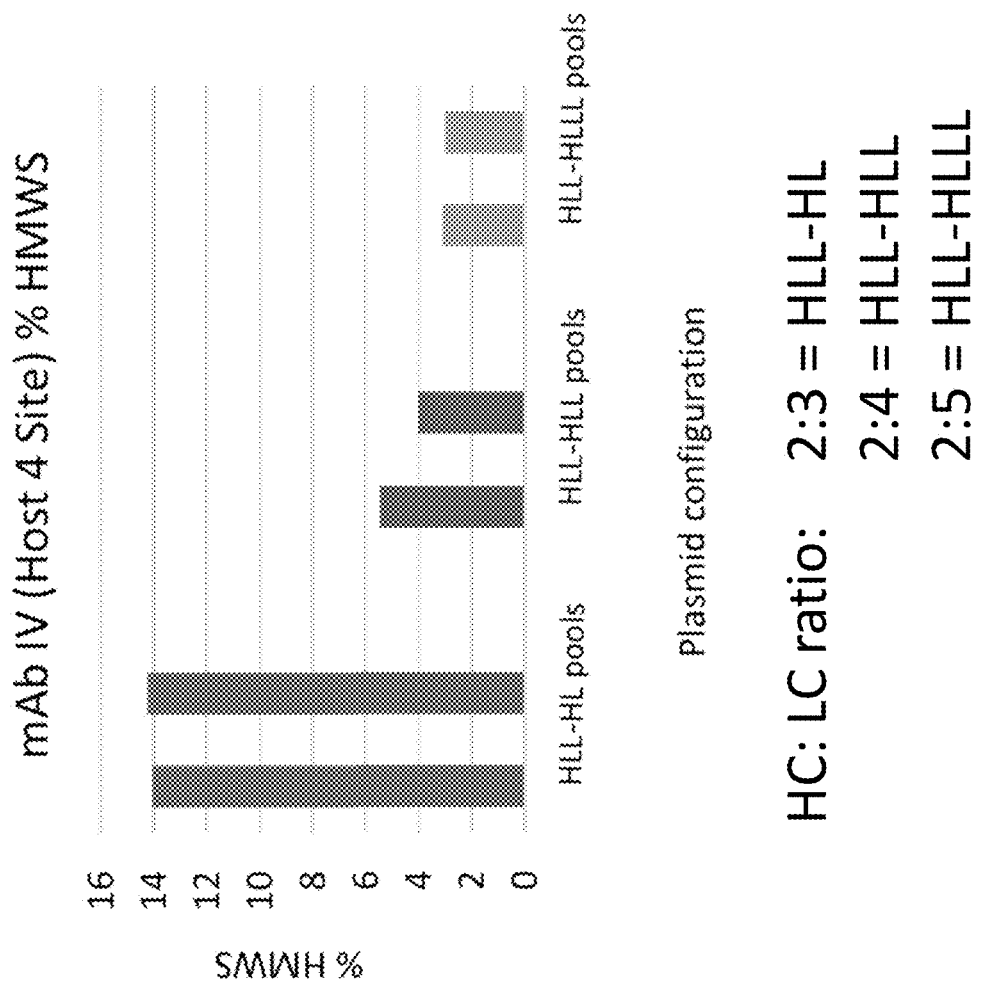

FIGS. 21 A to D depict expression levels, titer and Qp of RMCE pools of various configurations. A schematic of the one heavy chain, one light chain plasmids transfected to assess the effect of plasmid position on chain expression is depicted in FIG. 21A. Antibody heavy (abbreviated as H) and light chain (abbreviated as L) were either expressed on the same plasmid or split between the front and back plasmids. L3, Loxfas, and 2 L sites are noted, as is the pac puromycin resistance gene in the back plasmid. Seed train mRNA expression of heavy and light chain from pools with DNA configurations outlined in FIG. 21A are depicted in FIG. 23B. Day 14 titer for the RMCE pools of the various configurations is depicted in FIG. 21C. Day 14 Qp of the various configurations is depicted in FIG. 21D. Heavy and light chain DNA copy number for the pools is depicted in FIG. 21E.

FIG. 22 A to D depict that the effect of HC:LC ratio on the High-molecular-weight species (HMWS) percentage of mAbs is independent of the TI site. Day 14 titer for antibody S on Host 7 cells is depicted in FIG. 22A. High-molecular-weight species (HMWS) percentage of antibody S is on Host 7 cells is depicted in FIG. 22B. Day 14 titer for antibody S on Host 4 cells is depicted in FIG. 22C. High-molecular-weight species (HMWS) percentage of antibody S is on Host 4 cells is depicted in FIG. 22D.

FIGS. 23 A and B depict the effect of HC:LC ration on productivity and High-molecular-weight species (HMWS) of antibody IV. Day 14 titer for antibody IV on Host 4 cells is depicted in FIG. 23A. High-molecular-weight species (HMWS) percentage of antibody IV on Host 4 cells is depicted in FIG. 23D.

Figure 24A:
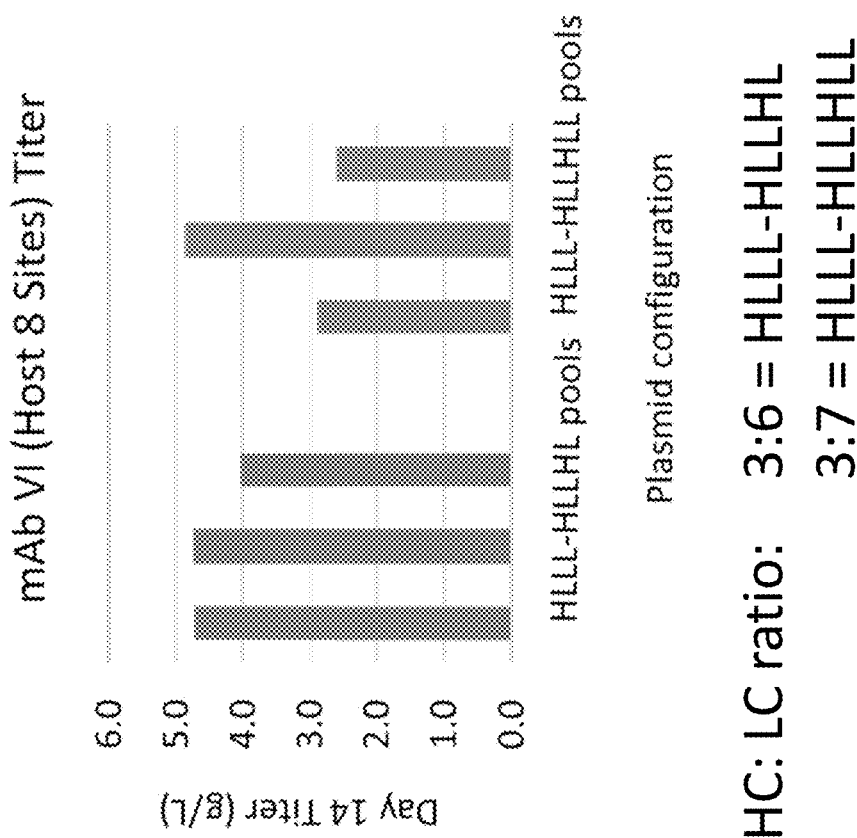
Figure 24B:
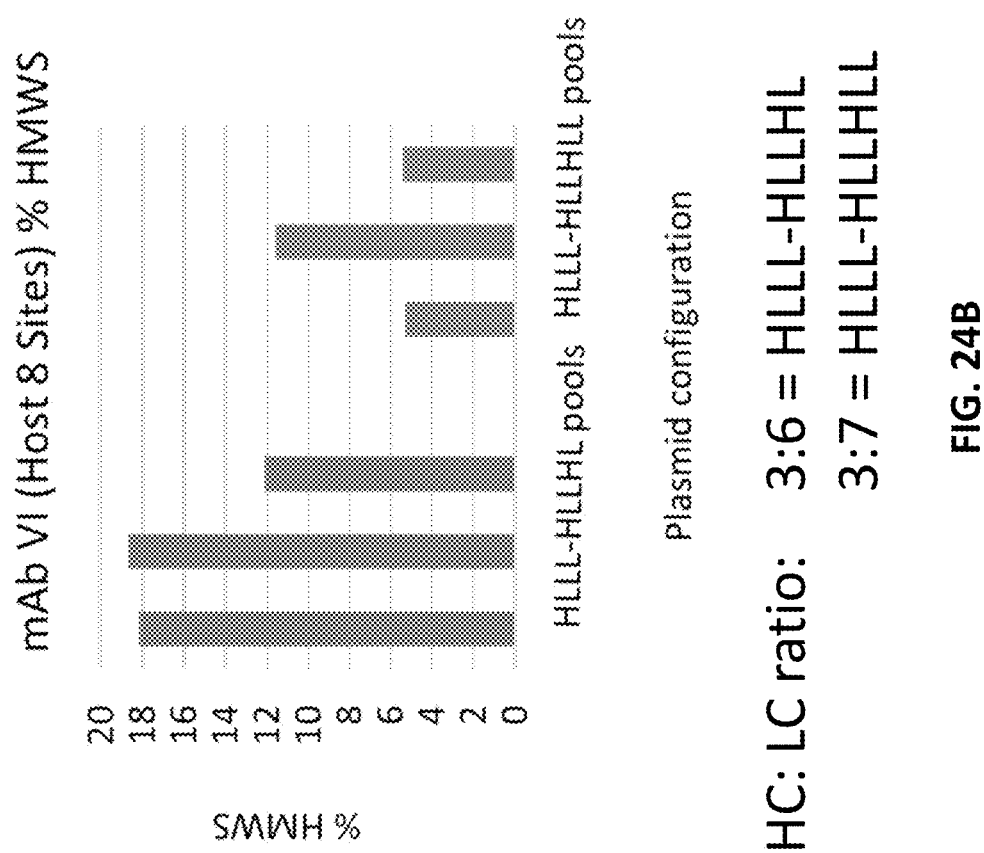

FIGS. 24 A and B depict the effect of HC:LC ratio on productivity and High-molecular-weight species (HMWS) of antibody VI in a two-site TI host cells. Day 14 titer for antibody VI on two-site TI host cells is depicted in FIG. 24A. High-molecular-weight species (HMWS) percentage of antibody VI on two-site TI host cells is depicted in FIG. 24B.

Figure 25:
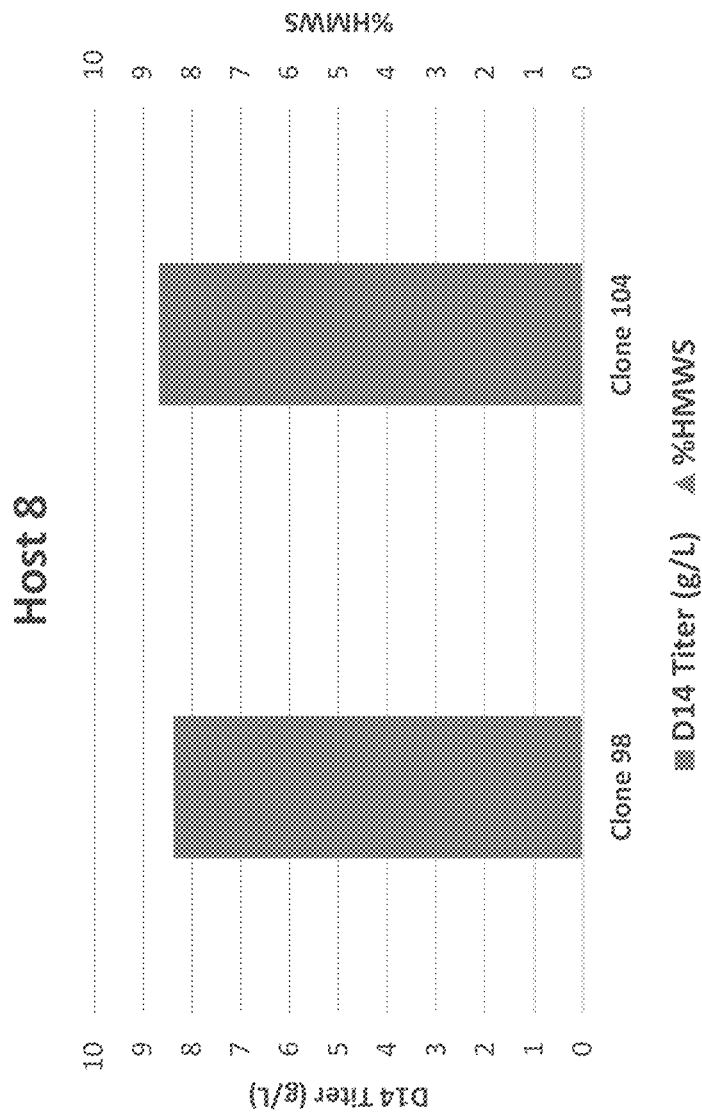

FIG. 25 depicts 2 clones with titers of 8.4 and 8.7 g/L with 7.4% and 5.6% aggregates, respectively.

Figure 26:
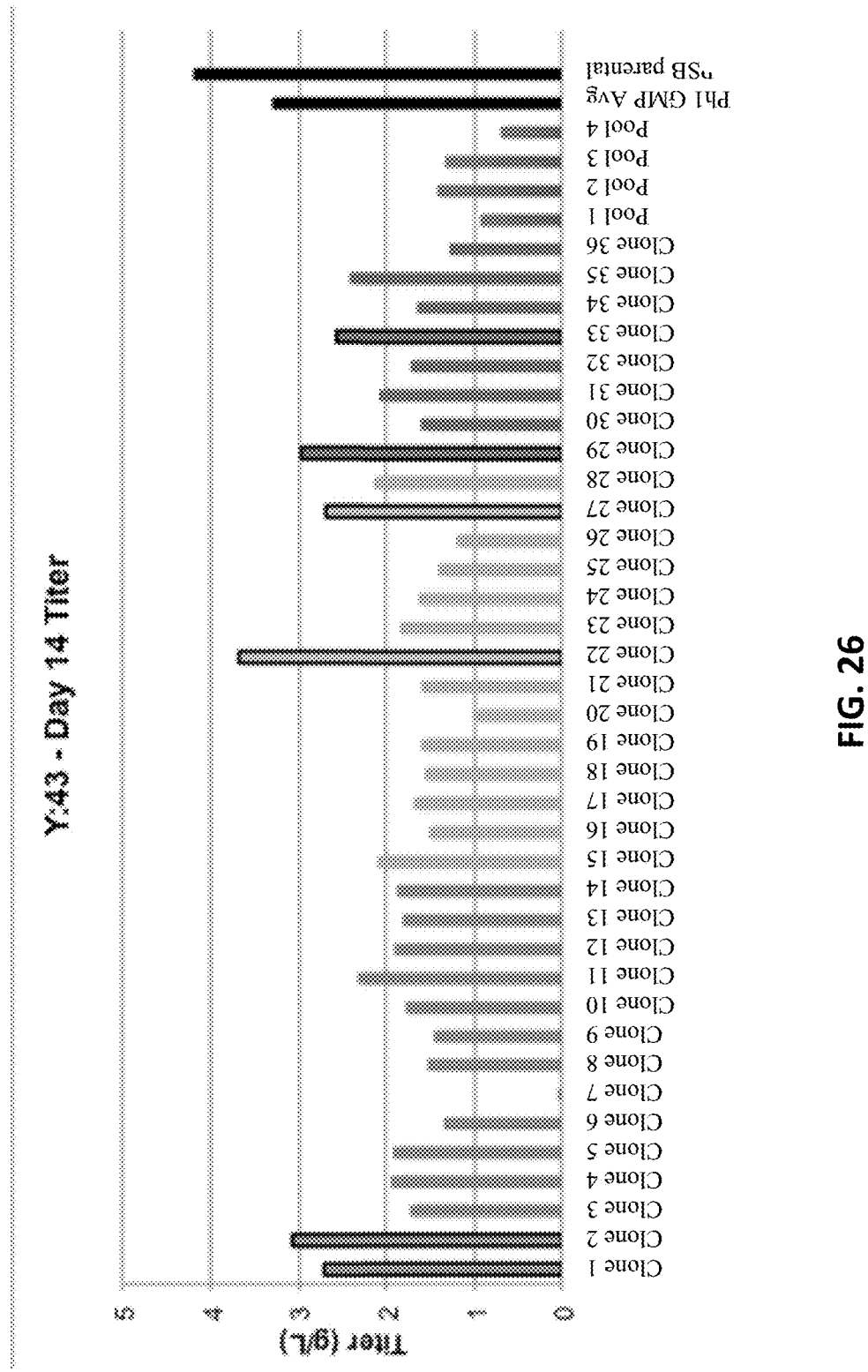

FIG. 26 depicts Day 14 titer of antibody Z in different regulated targeted integration cell lines.

Figure 27:
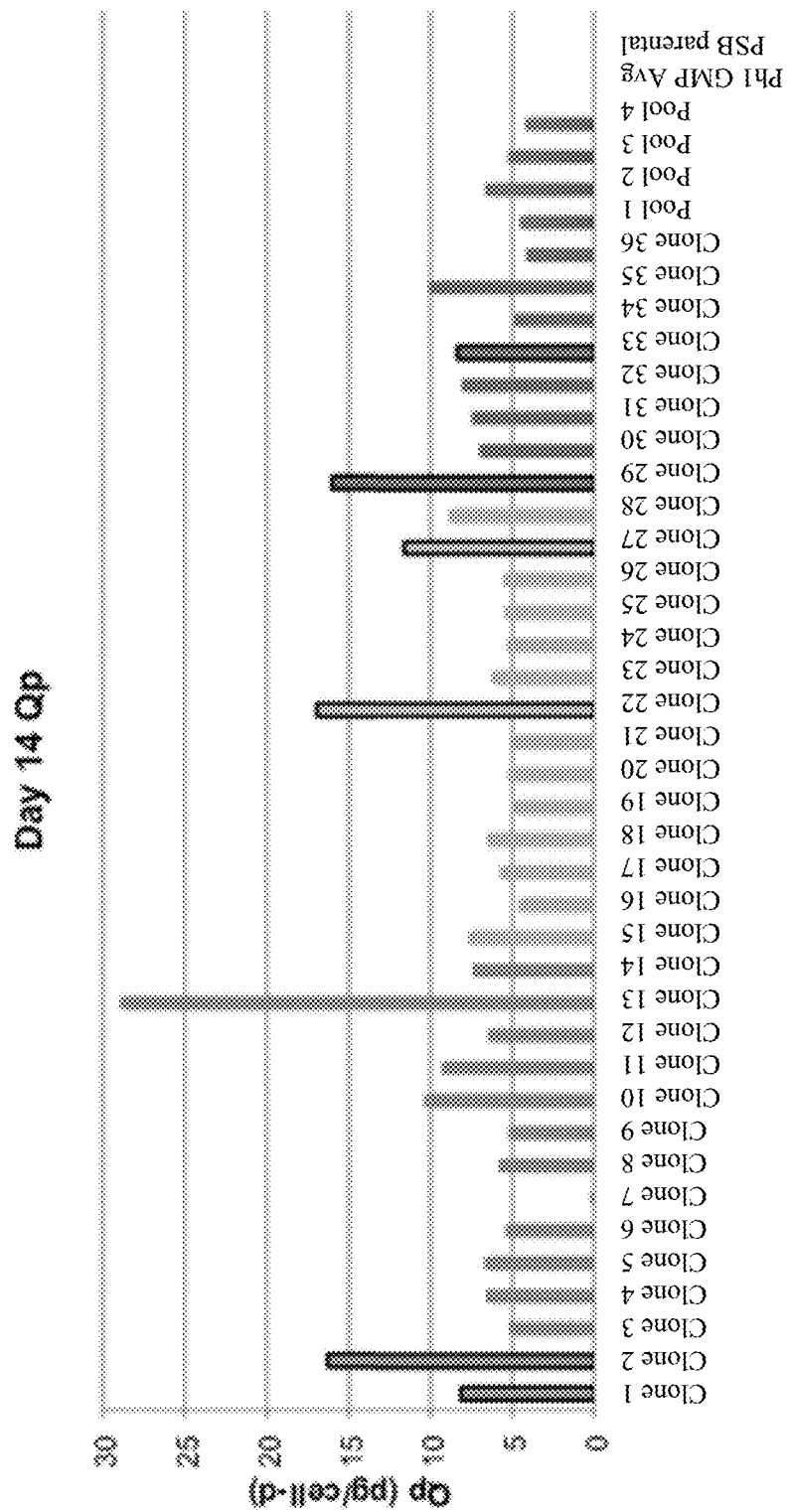

FIG. 27 specific productivity of antibody Z in different regulated targeted integration cell lines.

DETAILED DESCRIPTION

In certain embodiments, the host cells, genetic constructs (e.g., vectors), compositions, and methods described herein can be employed in the development and/or use of a targeted integration (TI) host cell. In certain embodiments, such TI host cells comprise an exogenous nucleotide sequence integrated within a specific gene or a specific locus of the genome of the host cell.

For purposes of clarity of disclosure and not by way of limitation, the detailed description is divided into the following subsections:
1. Definitions
2. Integration Sites
3. Exogenous Nucleotide Sequences
4. Host Cells
5. Targeted Integration
6. Preparation and Use of TI Host Cells
7. Products
8. Exemplary Non-Limiting Embodiments

1. Definitions

Unless otherwise defined, all technical and scientific terms used herein have the same meaning as commonly understood by one of ordinary skill in the art. In case of conflict, the present document, including definitions, will control. Preferred methods and materials are described below, although methods and materials similar or equivalent to those described herein can be used in practice or testing of the presently disclosed subject matter. All publications, patent applications, patents and other references mentioned herein are incorporated by reference in their entirety. The materials, methods, and examples disclosed herein are illustrative only and not intended to be limiting.

The terms "comprise(s)," "include(s)," "having," "has," "can," "contain(s)," and variants thereof, as used herein, are intended to be open-ended transitional phrases, terms, or words that do not preclude the possibility of additional acts or structures. The singular forms "a," "an" and "the" include plural references unless the context clearly dictates otherwise. The present disclosure also contemplates other embodiments "comprising," "consisting of", and "consisting essentially of," the embodiments or elements presented herein, whether explicitly set forth or not.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

As used herein, the term "about" or "approximately" means within an acceptable error range for the particular value as determined by one of ordinary skill in the art, which will depend in part on how the value is measured or determined, i.e., the limitations of the measurement system. For example, "about" can mean within 3 or more than 3 standard deviations, per the practice in the art. Alternatively, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5-fold, and more preferably within 2-fold, of a value.

As used herein, the term "selection marker" can be a gene that allows cells carrying the gene to be specifically selected for or against, in the presence of a corresponding selection agent. For example, but not by way of limitation, a selection marker can allow the host cell transformed with the selection marker gene to be positively selected for in the presence of the gene; a non-transformed host cell would not be capable of growing or surviving under the selective conditions. Selection markers can be positive, negative or bi-functional. Positive selection markers can allow selection for cells carrying the marker, whereas negative selection markers can allow cells carrying the marker to be selectively eliminated. A selection marker can confer resistance to a drug or compensate for a metabolic or catabolic defect in the host cell. In prokaryotic cells, amongst others, genes conferring resistance against ampicillin, tetracycline, kanamycin or chloramphenicol can be used. Resistance genes useful as selection markers in eukaryotic cells include, but are not limited to, genes for aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid. Further marker genes are described in WO 92/08796 and WO 94/28143.

Beyond facilitating a selection in the presence of a corresponding selection agent, a selection marker can alternatively provide a gene encoding a molecule normally not present in the cell, e.g., green fluorescent protein (GFP), enhanced GFP (eGFP), synthetic GFP, yellow fluorescent protein (YFP), enhanced YFP (eYFP), cyan fluorescent protein (CFP), mPlum, mCherry, tdTomato, mStrawberry, J-red, DsRed-monomer, mOrange, mKO, mCitrine, Venus, YPet, Emerald, CyPet, mCFPm, Cerulean, and T-Sapphire. Cells harboring such a gene can be distinguished from cells not harboring this gene, e.g., by the detection of the fluorescence emitted by the encoded polypeptide.

As used herein, the term "operably linked" refers to a juxtaposition of two or more components, wherein the components are in a relationship permitting them to function in their intended manner. For example, a promoter and/or an enhancer is operably linked to a coding sequence if the promoter and/or enhancer acts to modulate the transcription of the coding sequence. In certain embodiments, DNA sequences that are "operably linked" are contiguous and adjacent on a single chromosome. In certain embodiments, e.g., when it is necessary to join two protein encoding regions, such as a secretory leader and a polypeptide, the sequences are contiguous, adjacent, and in the same reading frame. In certain embodiments, an operably linked promoter is located upstream of the coding sequence and can be adjacent to it. In certain embodiments, e.g., with respect to enhancer sequences modulating the expression of a coding sequence, the two components can be operably linked although not adjacent. An enhancer is operably linked to a coding sequence if the enhancer increases transcription of the coding sequence. Operably linked enhancers can be located upstream, within, or downstream of coding sequences and can be located a considerable distance from the promoter of the coding sequence. Operable linkage can be accomplished by recombinant methods known in the art, e.g., using PCR methodology and/or by ligation at convenient restriction sites. If convenient restriction sites do not exist, then synthetic oligonucleotide adaptors or linkers can be used in accord with conventional practice. An internal ribosomal entry site (IRES) is operably linked to an open reading frame (ORF) if it allows initiation of translation of the ORF at an internal location in a 5' end-independent manner.

As used herein, the term "expression" refers to transcription and/or translation. In certain embodiments, the level of transcription of a desired product can be determined based on the amount of corresponding mRNA that is present. For example, mRNA transcribed from a sequence of interest can be quantitated by PCR or by Northern hybridization. In certain embodiments, protein encoded by a sequence of interest can be quantitated by various methods, e.g. by ELISA, by assaying for the biological activity of the protein, or by employing assays that are independent of such activity, such as Western blotting or radioimmunoassay, using antibodies that recognize and bind to the protein.

The term "antibody" herein is used in the broadest sense and encompasses various antibody structures, including but not limited to monoclonal antibodies, polyclonal antibodies, multispecific antibodies (e.g., bispecific antibodies), half antibodies, and antibody fragments so long as they exhibit a desired antigen-binding activity.

As used herein, the term "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies; linear antibodies; single-chain antibody molecules (e.g., scFv); and multispecific antibodies formed from antibody fragments. For a review of certain antibody fragments, see Holliger and Hudson, Nature Biotechnology 23:1126-1136 (2005).

As used herein, the term "variable region" or "variable domain" refers to the domain of an antibody heavy or light chain that is involved in binding the antibody to antigen. The variable domains of the heavy chain and light chain ($V_H$ and $V_L$, respectively) of a native antibody generally have similar structures, with each domain comprising four conserved framework regions (FRs) and three hypervariable regions (HVRs). (See, e.g., Kindt et al. Kuby Immunology, 6th ed., W.H. Freeman and Co., page 91 (2007).) A single $V_H$ or $V_L$ domain may be sufficient to confer antigen-binding specificity. Furthermore, antibodies that bind to a particular antigen may be isolated using a $V_H$ or $V_L$ domain from an antibody that binds the antigen to screen a library of complementary $V_L$ or $V_H$ domains, respectively. See, e.g., Portolano et al., J. Immunol. 150:880-887 (1993); Clarkson et al., Nature 352:624-628 (1991).

As used herein, the term "heavy chain" refers to an immunoglobulin heavy chain.

As used herein, the term "light chain" refers to an immunoglobulin light chain.

The "class" of an antibody refers to the type of constant domain or constant region possessed by its heavy chain.

There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called α, δ, ε, γ, and μ, respectively.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

"Multispecific antibodies" are monoclonal antibodies that have binding specificities for at least two different sites, i.e., different epitopes on different antigens or different epitopes on the same antigen. In certain aspects, the multispecific antibody has three or more binding specificities. Multispecific antibodies may be prepared as full-length antibodies or antibody fragments.

The terms "full length antibody", "intact antibody", and "whole antibody" are used herein interchangeably to refer to an antibody having a structure substantially similar to a native antibody structure or having heavy chains that contain an Fc region as defined herein.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies; linear antibodies; single-chain antibody molecules (e.g., scFv, and scFab); single domain antibodies (dAbs); and multispecific antibodies formed from antibody fragments. For a review of certain antibody fragments, see Holliger and Hudson, Nature Biotechnology 23:1126-1136 (2005).

The term "chimeric" antibody refers to an antibody in which a portion of the heavy and/or light chain is derived from a particular source or species, while the remainder of the heavy and/or light chain is derived from a different source or species.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "humanized" antibody refers to a chimeric antibody comprising amino acid residues from non-human CDRs and amino acid residues from human FRs. In certain aspects, a humanized antibody will comprise substantially all of at least one, and typically two, variable domains, in which all or substantially all of the CDRs correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method.

The term "therapeutic antibody" refers to an antibody that is used in the treatment of disease. A therapeutic antibody may have various mechanisms of action. A therapeutic antibody may bind and neutralize the normal function of a target associated with an antigen. For example, a monoclonal antibody that blocks the activity of the of protein needed for the survival of a cancer cell causes the cell's death. Another therapeutic monoclonal antibody may bind and activate the normal function of a target associated with an antigen. For example, a monoclonal antibody can bind to a protein on a cell and trigger an apoptosis signal. Yet another monoclonal antibody may bind to a target antigen expressed only on diseased tissue; conjugation of a toxic payload (effective agent), such as a chemotherapeutic or radioactive agent, to the monoclonal antibody can create an agent for specific delivery of the toxic payload to the diseased tissue, reducing harm to healthy tissue. A "biologically functional fragment" of a therapeutic antibody will exhibit at least one if not some or all of the biological functions attributed to the intact antibody, the function comprising at least specific binding to the target antigen.

The term "diagnostic antibody" refers to an antibody that is used as a diagnostic reagent for a disease. The diagnostic antibody may bind to a target antigen that is specifically associated with, or shows increased expression in, a particular disease. The diagnostic antibody may be used, for example, to detect a target in a biological sample from a patient, or in diagnostic imaging of disease sites, such as tumors, in a patient. A "biologically functional fragment" of a diagnostic antibody will exhibit at least one if not some or all of the biological functions attributed to the intact antibody, the function comprising at least specific binding to the target antigen.

The terms "host cell", "host cell line", and "host cell culture" are used interchangeably and refer to cells into which exogenous nucleic acid has been introduced, including the progeny of such cells. Host cells include "transformants" and "transformed cells", which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

The term "nucleic acid molecule" or "polynucleotide" includes any compound and/or substance that comprises a polymer of nucleotides. Each nucleotide is composed of a base, specifically a purine- or pyrimidine base (i.e. cytosine (C), guanine (G), adenine (A), thymine (T) or uracil (U)), a sugar (i.e. deoxyribose or ribose), and a phosphate group. Often, the nucleic acid molecule is described by the sequence of bases, whereby said bases represent the primary structure (linear structure) of a nucleic acid molecule. The sequence of bases is typically represented from 5' to 3'. Herein, the term nucleic acid molecule encompasses deoxyribonucleic acid (DNA) including e.g., complementary DNA (cDNA) and genomic DNA, ribonucleic acid (RNA), in particular messenger RNA (mRNA), synthetic forms of DNA or RNA, and mixed polymers comprising two or more of these molecules. The nucleic acid molecule may be linear or circular. In addition, the term nucleic acid molecule includes both, sense and antisense strands, as well as single stranded and double stranded forms. Moreover, the herein described nucleic acid molecule can contain naturally occurring or non-naturally occurring nucleotides. Examples of non-naturally occurring nucleotides include modified nucleotide bases with derivatized sugars or phosphate backbone linkages or chemically modified residues. Nucleic acid molecules also encompass DNA and RNA molecules which are suitable as a vector for direct expression of an antibody of the invention in vitro and/or in vivo, e.g., in a host or patient. Such DNA (e.g., cDNA) or RNA (e.g., mRNA) vectors, can be unmodified or modified. For example, mRNA can be chemically modified to enhance the stability of the RNA vector and/or expression of the encoded molecule so that mRNA can be injected into a subject to generate the antibody in vivo (see e.g., Stadler et al, Nature Medicine 2017, published online 12 Jun. 2017, doi:10.1038/nm.4356 or EP 2 101 823 B1).

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

As used herein, the term "vector" refers to a nucleic acid molecule capable of propagating another nucleic acid to which it is linked. The term includes the vector as a self-replicating nucleic acid structure as well as the vector incorporated into the genome of a host cell into which it has been introduced. In certain embodiments, vectors direct the expression of nucleic acids to which they are operatively linked. Such vectors are referred to herein as "expression vectors."

As used herein, the term "homologous sequences" refers to sequences that share a significant sequence similarity as determined by an alignment of the sequences. For example, two sequences can be about 50%, 60%, 70%, 80%, 90%, 95%, 99%, or 99.9% homologous. The alignment is carried out by algorithms and computer programs including, but not limited to, BLAST, FASTA, and HMME, which compares sequences and calculates the statistical significance of matches based on factors such as sequence length, sequence identify and similarity, and the presence and length of sequence mismatches and gaps. Homologous sequences can refer to both DNA and protein sequences.

As used herein, the term "flanking" refers to that a first nucleotide sequence is located at either a 5' or 3' end, or both ends of a second nucleotide sequence. The flanking nucleotide sequence can be adjacent to or at a defined distance from the second nucleotide sequence. There is no specific limit of the length of a flanking nucleotide sequence. For example, a flanking sequence can be a few base pairs or a few thousand base pairs. In certain embodiments, the length of a flanking nucleotide sequence can be about at least 15 base pairs, at least 20 base pairs, at least 30 base pairs, at least 40 base pairs, at least 50 base pairs, at least 75 base pairs, at least 100 base pairs, at least 150 base pairs, at least 200 base pairs, at least 300 base pairs, at least 400 base pairs, at least 500 base pairs, at least 1,000 base pairs, at least 1,500 base pairs, at least 2,000 base pairs, at least 3,000 base pairs, at least 4,000 base pairs, at least 5,000 base pairs, at least 6,000 base pairs, at least 7,000 base pairs, at least 8,000 base pairs, at least 9,000 base pairs, at least 10,000 base pairs.

As used herein, the term "exogenous" indicates that a nucleotide sequence does not originate from a host cell and is introduced into a host cell by traditional DNA delivery methods, e.g., by transfection, electroporation, or transformation methods. The term "endogenous" refers to that a nucleotide sequence originates from a host cell. An "exogenous" nucleotide sequence can have an "endogenous" counterpart that is identical in base compositions, but where the "exogenous" sequence is introduced into the host cell, e.g., via recombinant DNA technology.

2. Integration Sites

The presently disclosed subject matter provides a host cell suitable for targeted integration of exogenous nucleotide sequences. In certain embodiments, the host cell comprises an exogenous nucleotide sequence integrated at an integration site on the genome of the host cell, i.e., a TI host cell.

An "integration site" comprises a nucleic acid sequence within a host cell genome into which an exogenous nucleotide sequence is inserted. In certain embodiments, an integration site is between two adjacent nucleotides on the host cell genome. In certain embodiments, an integration site includes a stretch of nucleotides between any of which an exogenous nucleotide sequence can be inserted. In certain embodiments, the integration site is located within a specific locus of the genome of the TI host cell. In certain embodiments, the integration site is within an endogenous gene of the TI host cell.

In certain embodiments, the exogenous nucleotide sequence is integrated at a site within a specific locus of the genome of a TI host cell. In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from SEQ ID Nos. 1-7.

In certain embodiments, the exogenous nucleotide sequence is integrated at a site within a specific locus of the genome of a TI host cell. In certain embodiments, the locus into which the exogenous nucleotide sequence is integrated is at least about 50%, at least about 60%, at least about 70%, at least about 80%, at least about 90%, at least about 95%, at least about 99%, or at least about 99.9% homologous to a sequence selected from Contigs NW_006874047.1, NW_006884592.1, NW_006881296.1, NW_003616412.1, NW_003615063.1, NW_006882936.1, and NW_003615411.1.

In certain embodiments, the exogenous nucleotide sequence is integrated at an integration site located within a position selected from nucleotides numbered 1-1,000 bp; 1,000-2,000 bp; 2,000-3,000 bp; 3,000-4,000 bp; and 4,000-4,301 bp of SEQ ID No. 1. In certain embodiments, the exogenous nucleotide sequence is integrated at an integration site located within a position selected from nucleotides numbered 1-100,000 bp; 100,000-200,000 bp; 200,000-300,000 bp; 300,000-400,000 bp; 400,000-500,000 bp; 500,000-600,000 bp; 600,000-700,000 bp; and 700,000-728785 bp of SEQ ID No. 2. In certain embodiments, the exogenous nucleotide sequence is integrated at an integration site located within a position selected from nucleotides numbered 1-100,000 bp; 100,000-200,000 bp; 200,000-300,000 bp; 300,000-400,000 bp; and 400,000-413,983 of SEQ ID No. 3. In certain embodiments, the exogenous nucleotide sequence is integrated at an integration site located within a position selected from nucleotides numbered 1-10,000 bp; 10,000-20,000 bp; 20,000-30,000 bp; and 30,000-30,757 bp of SEQ ID No. 4. In certain embodiments, the exogenous nucleotide sequence is integrated at an integration site located within a position selected from nucleotides numbered 1-10,000 bp; 10,000-20,000 bp; 20,000-30,000 bp; 30,000-40,000 bp; 40,000-50,000 bp; 50,000-60,000 bp; and 60,000-68,962 bp of SEQ ID No. 5. In certain embodiments, the exogenous nucleotide sequence is integrated at an integration site located within a position selected from nucleotides numbered 1-10,000 bp; 10,000-20,000 bp; 20,000-30,000 bp; 30,000-40,000 bp; 40,000-50,000 bp; and 50,000-51,326 bp of SEQ ID No. 6. In certain embodiments, the exogenous nucleotide sequence is integrated at an integration site located within a position selected from nucleotides numbered 1-10,000 bp; 10,000-20,000 bp; and 20,000-22,904 bp of SEQ ID No. 7.

In certain embodiments, the nucleotide sequence immediately 5' of the integrated exogenous sequence is selected from the group consisting of nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, or nucleotides 82214-97705 of NW_003615411.1 and sequences at least 50% homologous thereto. In certain embodiments, the nucleotide sequence immediately 5' of the integrated exogenous sequence are at least about 50%, at least about 60%, at least about 70%, at least about 80%, at least about 90%, at least about 95%, at least about 99%, or at least about 99.9% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, or nucleotides 82214-97705 of NW_003615411.1.

In certain embodiments, the nucleotide sequence immediately 3' of the integrated exogenous sequence is selected from the group consisting of nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1 and sequences at least 50% homologous thereto. In certain embodiments, the nucleotide sequence immediately 3' of the integrated exogenous sequence is at least about 50%, at least about 60%, at least about 70%, at least about 80%, at least about 90%, at least about 95%, at least about 99%, or at least about 99.9% homologous to nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1.

In certain embodiments, the integrated exogenous nucleotide sequence is operably linked to a nucleotide sequence selected from the group consisting of SEQ ID. Nos. 1-7 and sequences at least 50% homologous thereto. In certain embodiments, the nucleotide sequence operably linked to the exogenous nucleotide sequence is at least about 50%, at least about 60%, at least about 70%, at least about 80%, at least about 90%, at least about 95%, at least about 99%, or at least about 99.9% homologous to a sequence selected from SEQ ID Nos. 1-7. In certain embodiments, the integrated exogenous nucleotide sequence comprises at least one SOI. In certain embodiments, the operably linked nucleotide sequence increases the expression level of the SOI compared to a randomly integrated SOI. In certain embodiments, the integrated exogenous SOI is expressed at about 20%, 30%, 40%, 50%, 100%, 2 fold, 3 fold, 5 fold, or 10 fold higher than a randomly integrated SOI.

In certain embodiments, the integrated exogenous sequence is flanked 5' by a nucleotide sequence selected from the group consisting of nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1.and sequences at least 50% homologous thereto, and is flanked 3' by a nucleotide sequence selected from the group consisting of nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, and nucleotides 97706-105117 of NW_003615411.1 and sequences at least 50% homologous thereto. In certain embodiments, the nucleotide sequence flanking 5' of the integrated exogenous nucleotide sequence is at least about 50%, at least about 60%, at least about 70%, at least about 80%, at least about 90%, at least about 95%, at least about 99%, or at least about 99.9% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1, and the nucleotide sequences flanking 3' of the integrated exogenous nucleotide sequence is at least about 50%, at least about 60%, at least about 70%, at least about 80%, at least about 90%, at least about 95%, at least about 99%, or at least about 99.9% homologous to SEQ ID Nos. nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-

362442 of NW_003615063.1, nucleotides 2662055-2701768 of NW_006882936.1, and nucleotides 97706-105117 of NW_003615411.1.

In certain embodiments, the integrated exogenous nucleotide is integrated into a locus immediately adjacent to all or a portion of a sequence selected from the group consisting of sequences at least about 90% homologous to a sequence selected from SEQ ID Nos. 1-7.

In certain embodiments, the integrated exogenous nucleotide sequence is adjacent to a nucleotide sequence selected from the group consisting of SEQ ID. Nos. 1-7 and sequences at least 50% homologous thereto. In certain embodiments, the integrated exogenous nucleotide sequence is within about 100 bp, about 200 bp, about 500 bp, about 1 kb distance from a sequence selected from the group consisting of SEQ ID. Nos. 1-7 and sequences at least 50% homologous thereto. In certain embodiments, the nucleotide sequence adjacent to the exogenous nucleotide sequence is at least about 50%, at least about 60%, at least about 70%, at least about 80%, at least about 90%, at least about 95%, at least about 99%, or at least about 99.9% homologous to a sequence selected from SEQ ID Nos. 1-7.

In certain embodiments, the exogenous nucleotide sequence is integrated at an integration site adjacent to a position selected from nucleotides numbered 1-1,000 bp; 1,000-2,000 bp; 2,000-3,000 bp; 3,000-4,000 bp; and 4,000-4,301 bp of SEQ ID No. 1. In certain embodiments, the exogenous nucleotide sequence is integrated at an integration site adjacent to a position selected from nucleotides numbered 1-100,000 bp; 100,000-200,000 bp; 200,000-300,000 bp; 300,000-400,000 bp; 400,000-500,000 bp; 500,000-600,000 bp; 600,000-700,000 bp; and 700,000-728785 bp of SEQ ID No. 2. In certain embodiments, the exogenous nucleotide sequence is integrated at an integration site adjacent to a position selected from nucleotides numbered 1-100,000 bp; 100,000-200,000 bp; 200,000-300,000 bp; 300,000-400,000 bp; and 400,000-413,983 of SEQ ID No. 3. In certain embodiments, the exogenous nucleotide sequence is integrated at an integration site adjacent to a position selected from nucleotides numbered 1-10,000 bp; 10,000-20,000 bp; 20,000-30,000 bp; and 30,000-30,757 bp of SEQ ID No. 4. In certain embodiments, the exogenous nucleotide sequence is integrated at an integration site adjacent to a position selected from nucleotides numbered 1-10,000 bp; 10,000-20,000 bp; 20,000-30,000 bp; 30,000-40,000 bp; 40,000-50,000 bp; 50,000-60,000 bp; and 60,000-68,962 bp of SEQ ID No. 5. In certain embodiments, the exogenous nucleotide sequence is integrated at an integration site adjacent to a position selected from nucleotides numbered 1-10,000 bp; 10,000-20,000 bp; 20,000-30,000 bp; 30,000-40,000 bp; 40,000-50,000 bp; and 50,000-51,326 bp of SEQ ID No. 6. In certain embodiments, the exogenous nucleotide sequence is integrated at an integration site adjacent to a position selected from nucleotides numbered 1-10,000 bp; 10,000-20,000 bp; and 20,000-22,904 bp of SEQ ID No. 7.

In certain embodiments, the locus comprising the integration site of the exogenous nucleotide sequence does not encode an open reading frame (ORF). In certain embodiments, the locus comprising the integration site of the exogenous nucleotide sequence includes cis-acting elements, e.g., promoters and enhancers. In certain embodiments, the locus comprising the integration site of the exogenous nucleotide sequence is free of any cis-acting elements, e.g., promoters and enhancers, that enhance gene expression.

In certain embodiments, an exogenous nucleotide sequence is integrated at an integration site within an endogenous gene selected from the group consisting of LOC107977062, LOC100768845, ITPR2, ERE67000.1, UBAP2, MTMR2, and XP_003512331.2. The endogenous LOC107977062, LOC100768845, ITPR2, ERE67000.1, UBAP2, MTMR2, and XP_003512331.2 genes include the wild-type and all homologous sequences of LOC107977062, LOC100768845, ITPR2, ERE67000.1, UBAP2, MTMR2, and XP_003512331.2 genes. In certain embodiments, the homologous sequences of LOC107977062, LOC100768845, ITPR2, ERE67000.1, UBAP2, MTMR2, and XP_003512331.2 genes can be at least about 50%, at least about 60%, at least about 70%, at least about 80%, at least about 90%, at least about 95%, at least about 99%, or at least about 99.9% homologous to the wild-type LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type mammalian LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type human LOC107977062, LOC100768845, ITPR2, ERE67000.1, UBAP2, MTMR2, and XP_003512331.2 genes. In certain embodiments, the LOC107977062, LOC100768845, ITPR2, ERE67000.1, UBAP2, MTMR2, and XP_003512331.2 genes are wild-type hamster LOC107977062, LOC100768845, ITPR2, ERE67000.1, UBAP2, MTMR2, and XP_003512331.2 genes.

In certain embodiments, the integration site is operably linked to an endogenous gene selected from the group consisting of LOC107977062, LOC100768845, ITPR2, ERE67000.1, UBAP2, MTMR2, XP_003512331.2, and at least about 90% homologous sequences thereof. In certain embodiments, the integration site is flanked by an endogenous gene selected from the group consisting of LOC107977062, LOC100768845, ITPR2, ERE67000.1, UBAP2, MTMR2, XP_003512331.2, and at least about 90% homologous sequences thereof.

Table 1 provides exemplary TI host cell integration sites:

TABLE 1

| | | | | |
|---|---|---|---|---|
| | | TI host cell integration sites | | |
| | Host Contig | Contig Size (kb) | Integration site (bp) | Gene (SEQ ID No.) |
| 1 | NW_006874047.1 (SEQ ID NO: 8) | 727 | 45269 | LOC107977062 (SEQ ID No. 1) |
| 2 | NW_006884592.1 (SEQ ID NO: 9) | 931 | 207911 | LOC100768845 (SEQ ID No. 2) |

TABLE 1-continued

TI host cell integration sites

| Host | Contig | Contig Size (kb) | Integration site (bp) | Gene (SEQ ID No.) |
|---|---|---|---|---|
| 3 | NW_006881296.1 (SEQ ID NO: 10) | 1016 | 491909 | ITPR2 (SEQ ID No. 3) |
| 4 | NW_003616412.1 (SEQ ID NO: 11) | 127 | 79768 | ERE67000.1 (SEQ ID No. 4) |
| 5 | NW_003615063.1 (SEQ ID NO: 12) | 372 | 315265 | UBAP2 (SEQ ID No. 5) |
| 6 | NW_006882936.1 (SEQ ID NO: 13) | 3042 | 2662054 | MTMR2 (SEQ ID No. 6) |
| 7 | NW_003615411.1 (SEQ ID NO: 14) | 277 | 97706 | XP_003512331.2 (SEQ ID No. 7) |

In certain embodiments, an integration site and/or the nucleotide sequences flanking the integration site can be identified experimentally. In certain embodiments, an integration site and/or the nucleotide sequences flanking the integration site can be identified by genome-wide screening approaches to isolate host cells that express, at a desirable level, a polypeptide of interest encoded by one or more SOIs integrated into one or more exogenous nucleotide sequences, where the exogenous sequences are themselves integrated into one or more loci in the genome of the host cell. In certain embodiments, an integration site and/or the nucleotide sequences flanking an integration site can be identified by genome-wide screening approaches following transposase-based cassette integration event. In certain embodiments, an integration site and/or the nucleotide sequences flanking an integration site can be identified by brute force random integration screening. In certain embodiments, an integration site and/or the nucleotide sequences flanking an integration site can be determined by conventional sequencing approaches such as target locus amplification (TLA) followed by next-generation sequencing (NGS) and whole-genome NGS. In certain embodiments, the location of an integration site on a chromosome can be determined by conventional cell biology approaches such as fluorescence in-situ hybridization (FISH) analysis.

In certain embodiments, a TI host cell comprises a first exogenous nucleotide sequence integrated at a first integration site within a specific first locus in the genome of the TI host cell and a second exogenous nucleotide sequence integrated at a second integration site within a specific second locus in the genome. In certain embodiments, a TI host cell comprises multiple exogenous nucleotide sequences integrated at multiple integration sites in the genome of the TI host cell.

In certain embodiments, the TI host cells of the present disclosure comprise at least two distinct exogenous nucleotide sequences, e.g., exogenous nucleotide sequences comprising at least one RRS. In certain embodiments, the two or more exogenous nucleotide sequences can be targeted for the introduction of one or more SOIs. In certain embodiments the SOIs are the same. In certain embodiments, the SOIs are distinct. In certain embodiments, a parental TI host cell comprising a first exogenous nucleotide sequence can comprise a second exogenous nucleotide sequence at an integration site that is different from the integration site of the first exogenous nucleotide sequence.

In certain embodiments, the integration site is at least about 50%, at least about 60%, at least about 70%, at least about 80%, at least about 90%, at least about 95%, at least about 99%, or at least about 99.9% homologous to a sequence selected from SEQ ID Nos. 1-7. In certain embodiments, the integration sites can be on the same chromosome. In certain embodiments, the integration sites are located within 1-1,000 nucleotides, 1,000-100,000 nucleotides, 100,000-1,000,000 nucleotides or more from each other in the same chromosome. In certain embodiments the integration sites are on different chromosomes. In certain embodiments, a TI host cell comprising an exogenous nucleotide sequence at one integration site can be used for the insertion of at least two, at least three, at least four, at least five, at least six, at least 7, at least 8, or more exogenous nucleotide sequences at the same or different integration sites.

In certain embodiments, the feasibility of recombinase-mediated cassette exchange (RMCE) of at least two integration sites can be evaluated for each site individually. In certain embodiments, the feasibility of RMCE at least two integration sites can be evaluated simultaneously. The feasibility of RMCE at multiple sites can evaluated by methods known in the art, e.g., measuring the polypeptide titer, or the polypeptide specific production. In certain embodiments, the evaluation can be performed by methods known in the art, e.g., by evaluating the titer and/or specific productivity of a culture of the TI host cell expressing the SOI(s). Exemplary culture strategies include, but are not limited to, fed-batch shake flask cultures and a bioreactor fed-batch cultures. Titer and specific productivity of the TI host cells expressing a polypeptide of interest can evaluated by methods known in the art, e.g., but not limited to, ELISA, FACS, Fluorometric Microvolume Assay Technology (FMAT), protein-A affinity chromatography, Western blot analysis.

3. Exogenous Nucleotide Sequences

An exogenous nucleotide sequence is a nucleotide sequence that does not originate from a host cell but can be introduced into a host cell by traditional DNA delivery methods, e.g., by transfection, electroporation, or transformation methods. In certain embodiments, the exogenous nucleotide sequence is a sequence of interest (SOI), e.g., a nucleotide sequence encoding a polypeptide of interest. In certain embodiments, however, the exogenous nucleotide sequences employed in the context of the instant disclosure comprises elements, e.g., one or more recombination recognition sequences (RRs) and one or more selection markers, which facilitate the introduction of additional nucleic acid sequences, e.g., SOIs. In certain embodiments, the exogenous nucleotide sequences facilitating the introduction of additional nucleic acid sequences are referred to herein as "landing pads." Accordingly, in certain embodiments, a TI host cell can comprise: (1) an exogenous nucleotide sequence that includes one or more SOIs, e.g., an SOI incorporated into a particular locus in a host cell genome via an exogenous site-specific nuclease mediated (e.g., CRISPR/Cas9-mediated) targeted integration; (2) an exogenous nucleotide sequence that includes one or more landing pads; or (3) an exogenous nucleotide sequence that includes one or more landing pads into which one or more SOIs have been incorporated.

In certain embodiments, a TI host cell comprises at least one exogenous nucleotide sequence integrated at one or more integration sites in the genome of the TI host cell. In certain embodiments, the exogenous nucleotide sequence is integrated at one or more integration sites within a specific a locus of the genome of the TI host cell. For example, but not by way of limitation, at least one exogenous nucleic acid sequence can be integrated at one or more locus having least about 50%, at least about 60%, at least about 70%, at least about 80%, at least about 90%, at least about 95%, at least about 99%, or at least about 99.9% homologous to a sequence selected from SEQ ID Nos. 1-7.

3.1 Landing Pads

In certain embodiments, an integrated exogenous nucleotide sequence comprises one or more recombination recognition sequence (RRS), wherein the RRS can be recognized by a recombinase. In certain embodiments, the integrated exogenous nucleotide sequence comprises at least two RRSs. In certain embodiments, the integrated exogenous nucleotide sequence comprises two RRSs and the two RRSs are the same. In certain embodiments, the integrated exogenous nucleotide sequence comprises two RRSs and the two RRSs are heterospecific, i.e., not recognized by the same recombinase. In certain embodiments, an integrated exogenous nucleotide sequence comprises three RRSs, wherein the third RRS is located between the first and the second RRS. In certain embodiments, the first and the second RRS are the same and the third RRS is different from the first or the second RRS. In certain embodiments, all three RRSs are heterospecific. In certain embodiments, an integrated exogenous nucleotide sequence comprises four, five, six, seven, or eight RRSs. In certain embodiments, an integrated exogenous nucleotide sequence comprises multiple RRSs. In certain embodiments, the multiple two or more RRSs are the same. In certain embodiments, the two or more RRSs are heterospecific. In certain embodiments each RRS can be recognized by a distinct recombinase. In certain embodiments, the subset of the total number of RRSs are the homospecific, i.e., recognized by the same recombinase, and a subset of the total number of RRSs are heterospecific, i.e., not recognized by the same recombinase. In certain embodiments, the RRS or RRSs can be selected from the group consisting of a LoxP sequence, a LoxP L3 sequence, a LoxP 2 L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a pC31 attP sequence, and a pC31 attB sequence.

In certain embodiments, the integrated exogenous nucleotide sequence comprises at least one selection marker. In certain embodiments, the integrated exogenous nucleotide sequence comprises one RRS and at least one selection marker. In certain embodiments, the integrated exogenous nucleotide sequence comprises a first and a second RRS, and at least one selection marker. In certain embodiments, a selection marker is located between the first and the second RRS. In certain embodiments, two RRSs flank at least one selection marker, i.e., a first RRS is located 5' upstream and a second RRS is located 3' downstream of the selection marker. In certain embodiments, a first RRS is adjacent to the 5' end of the selection marker and a second RRS is adjacent to the 3' end of the selection marker.

In certain embodiments, a selection marker is located between a first and a second RRS and the two flanking RRSs are the same. In certain embodiments, the two RRSs flanking the selection marker are both LoxP sequences. In certain embodiments, the two RRSs flanking the selection marker are both FRT sequences. In certain embodiments, a selection marker is located between a first and a second RRS and the two flanking RRSs are heterospecific. In certain embodiments, the first flanking RRS is a LoxP L3 sequence and the second flanking RRS is a LoxP 2 L sequence. In certain embodiments, a LoxP L3 sequenced is located 5' of the selection marker and a LoxP 2 L sequence is located 3' of the selection marker. In certain embodiments, the first flanking RRS is a wild-type FRT sequence and the second flanking RRS is a mutant FRT sequence. In certain embodiments, the first flanking RRS is a Bxb1 attP sequence and the second flanking RRS is a Bxb1 attB sequence. In certain embodiments, the first flanking RRS is a φC31 attP sequence and the second flanking RRS is a φC31 attB sequence. In certain embodiments, the two RRSs are positioned in the same orientation. In certain embodiments, the two RRSs are both in the forward or reverse orientation. In certain embodiments, the two RRSs are positioned in opposite orientation.

In certain embodiments, a selection marker can be an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, or mycophenolic acid. In certain embodiments, a selection marker can be a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, or a T-Sapphire marker. In certain embodiments, the selection marker can be a fusion construct comprising at least two selection markers. In certain embodiments the gene encoding a selection marker or a fragment of the selection marker can be fused to the gene encoding a different selection marker or a fragment thereof.

In certain embodiments, the integrated exogenous nucleotide sequence comprises two selection markers flanked by two RRSs, wherein a first selection marker is different from a second selection marker. In certain embodiments, the two selection markers are both selected from the group consisting of a glutamine synthetase selection marker, a thymidine kinase selection marker, a HYG selection marker, and a puromycin resistance selection marker. In certain embodiments, the integrated exogenous nucleotide sequence comprises a thymidine kinase selection marker and a HYG selection marker. In certain embodiments, the first selection maker is selected from the group consisting of an aminoglycoside phosphotransferase (APH) (e.g., hygromycin phosphotransferase (HYG), neomycin and G418 APH), dihydrofolate reductase (DHFR), thymidine kinase (TK), glutamine synthetase (GS), asparagine synthetase, tryptophan synthetase (indole), histidinol dehydrogenase (histidinol D), and genes encoding resistance to puromycin, blasticidin, bleomycin, phleomycin, chloramphenicol, Zeocin, and mycophenolic acid, and the second selection maker is selected from the group consisting of a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, and a T-Sapphire marker. In certain embodiments, the first selection marker is a glutamine synthetase selection marker and the second selection marker is a GFP marker. In certain embodiments, the two RRSs flanking both selection markers are the same. In certain embodiments, the two RRSs flanking both selection markers are different.

In certain embodiments, the selection marker is operably linked to a promoter sequence. In certain embodiments, the selection marker is operably linked to an SV40 promoter. In certain embodiments, the selection marker is operably linked to a Cytomegalovirus (CMV) promoter.

In certain embodiments, the integrated exogenous nucleotide sequence comprises at least one selection marker and an IRES, wherein the RES is operably linked to the selection marker. In certain embodiments, the selection marker operably linked to the IRES is selected from the group consisting of a GFP, an eGFP, a synthetic GFP, a YFP, an eYFP, a CFP, an mPlum, an mCherry, a tdTomato, an mStrawberry, a J-red, a DsRed-monomer, an mOrange, an mKO, an mCitrine, a Venus, a YPet, an Emerald, a CyPet, an mCFPm, a Cerulean, and a T-Sapphire marker. In certain embodiments, the selection marker operably linked to the IRES is a GFP marker. In certain embodiments, the integrated exogenous nucleotide sequence comprises an IRES and two selection markers flanked by two RRSs, wherein the IRES is operably linked to the second selection marker. In certain embodiments, the integrated exogenous nucleotide sequence comprises an IRES and three selection markers flanked by two RRSs, wherein the RES is operably linked to the third selection marker. In certain embodiments, the integrated exogenous nucleotide sequence comprises an IRES and three selection markers flanked by two RRSs, wherein the IRES is operably linked to the third selection marker. In certain embodiments, the third selection marker is different from the first or the second selection marker. In certain embodiments, the integrated exogenous nucleotide sequence comprises a first selection marker operably linked to a promoter and a second selection marker operably linked to an TRES. In certain embodiments, the integrated exogenous nucleotide sequence comprises a glutamine synthetase selection marker operably linked to a SV40 promoter and a GFP selection marker operably linked to an RES. In certain embodiments, the integrated exogenous nucleotide sequence comprises a thymidine kinase selection marker and a HYG selection marker operably linked to a CMV promoter and a GFP selection marker operably linked to an IRES.

In certain embodiments, the integrated exogenous nucleotide sequence comprises three RRSs. In certain embodiments, the third RRS is located between the first and the second RRS. In certain embodiments, all three RRSs are the same. In certain embodiments, the first and the second RRS are the same, and the third RRS is different from the first or the second RRS. In certain embodiments, all three RRSs are heterospecific.

3.2 Sequences of Interest (SOIs)

In certain embodiments, the integrated exogenous nucleotide sequence comprises at least one exogenous SOI. In certain embodiments, the integrated exogenous nucleotide sequence comprises at least one selection marker and at least one exogenous SOI. In certain embodiments, the integrated exogenous nucleotide sequence comprises at least one selection marker, at least one exogenous SOI, and at least one RRS. In certain embodiments, the integrated exogenous nucleotide sequence comprises at least one, at least two, at least three, at least four, at least five, at least six, at least seven, at least eight or more SOIs. In certain embodiments the SOIs are the same. In certain embodiments, the SOIs are different.

In certain embodiments the SOI encodes a single chain antibody or fragment thereof. In certain embodiments, the SOI encodes an antibody heavy chain sequence or fragment thereof. In certain embodiments, the SOI encodes an antibody light chain sequence or fragment thereof. In certain embodiments, an integrated exogenous nucleotide sequence comprises an SOI encoding an antibody heavy chain sequence or fragment thereof and an SOI encoding an antibody light chain sequence or fragment thereof. In certain embodiments, an integrated exogenous nucleotide sequence comprises an SOI encoding a first antibody heavy chain sequence or fragment thereof, an SOI encoding a second antibody heavy chain sequence or fragment thereof, and an SOI encoding an antibody light chain sequence or fragment thereof. In certain embodiments, an integrated exogenous nucleotide sequence comprises an SOI encoding a first antibody heavy chain sequence or fragment thereof, an SOI encoding a second antibody heavy chain sequence or fragment thereof, an SOI encoding a first antibody light chain sequence or fragment thereof and a second SOI encoding an antibody light chain sequence or fragment thereof. In certain embodiments, the number of SOIs encoding for heavy and light chain sequences can be selected to achieve a desired expression level of the heavy and light chain polypeptides, e.g., to achieve a desired amount of bispecific antibody production. In certain embodiments, the individual SOIs encoding heavy and light chain sequences can be integrated, e.g., into a single exogenous nucleic acid sequence present at a single integration site, into multiple exogenous nucleic acid sequences present at a single integration site, or into multiple exogenous nucleic acid sequences integrated at distinct integration sites within the TI host cell.

In certain embodiments, the integrated exogenous nucleotide sequence comprises at least one selection marker, at least one exogenous SOI, and one RRS. In certain embodiments, the RRS is located adjacent to at least one selection marker or at least one exogenous SOI. In certain embodiments, the integrated exogenous nucleotide sequence comprises at least one selection marker, at least one exogenous SOI, and two RRSs. In certain embodiments, the integrated exogenous nucleotide sequence comprises at least one selection marker and at least one exogenous SOI located between the first and the second RRS. In certain embodiments, the two RRSs flanking the selection marker and the exogenous SOI are the same. In certain embodiments, the two RRSs flanking the selection marker and the exogenous SOI are different. In certain embodiments, the first flanking RRS is a LoxP L3 sequence and the second flanking RRS is a LoxP 2 L sequence. In certain embodiments, a L3 LoxP sequenced is located 5' of the selection marker and the exogenous SOI, and a LoxP 2 L sequence is located 3' of the selection marker and the exogenous SOI.

In certain embodiments, the integrated exogenous nucleotide sequence comprises three RRSs and two exogenous SOIs, and the third RRS is located between the first and the second RRS. In certain embodiments, the first SOI is located between the first and the third RRS, and the second SOI is located between the third and the second RRS. In certain embodiments, the first and the second SOI are different. In certain embodiments, the first and the second RRS are the same and the third RRS is different from the first or the second RRS. In certain embodiments, all three RRSs are heterospecific. In certain embodiments, the first RRS is a LoxP L3 site, the second RRS is a LoxP 2 L site, and the third RRS is a LoxFas site. In certain embodiments, the integrated exogenous nucleotide sequence comprises three RRSs, one exogenous SOI, and one selection marker. In certain embodiments, the SOI is located between the first and the third RRS, and the selection marker is located between the third and the second RRS. In certain embodiments, the integrated exogenous nucleotide sequence comprises three RRSs, two exogenous SOIs, and one selection marker. In certain embodiments, the first SOI and the selection marker are located between the first and the third RRS, and the second SOI is located between the third and the second RRS.

In certain embodiments, the exogenous SOI encodes a polypeptide of interest. Such polypeptides of interest can be selected from the group including, but not limited to, an antibody, an enzyme, a cytokine, a growth factor, a hormone, a viral protein, a bacterial protein, a vaccine protein, or a protein with therapeutic function. In certain embodiments, the exogenous SOI encodes an antibody or an antigen-binding fragment thereof. In certain embodiments, the exogenous SOI encodes a single chain antibody, an antibody light chain, an antibody heavy chain, a single-chain Fv fragment (scFv), or an Fc fusion protein. In certain embodiments, the exogenous SOI (or SOIs) encodes a standard antibody. In certain embodiments, the exogenous SOI (or SOIs) encodes a half-antibody, for example, but not limited to, antibodies B, Q, T and mAb I of the present disclosure. In certain embodiments, the exogenous SOI (or SOIs) encodes a complex antibody. In certain embodiments, the complex antibody can be a bispecific antibody, for example, but not limited to, Bispecific Molecule A, Bispecific Molecule B, Bispecific Molecule C, or Bispecific Molecule D of the present disclosure. In certain embodiments, the exogenous SOI is operably linked to at least one cis-acting element, for example, a promoter or an enhancer. In certain embodiments, the exogenous SOI is operably linked to a CMV promoter.

In certain embodiments, the integrated exogenous nucleotide sequence comprises two RRSs and at least two exogenous SOIs located between the two RRSs. In certain embodiments, SOIs encoding one heavy chain and one light chain of an antibody are located between the two RRSs. In certain embodiments, SOIs encoding one heavy chain and two light chains of an antibody are located between the two RRSs. In certain embodiments, SOIs encoding different combinations of copies of heavy chain and light chain of an antibody are located between the two RRSs.

In certain embodiments, the integrated exogenous nucleotide sequence comprises three RRSs and at least two exogenous SOIs, and the third RRS is located between the first and the second RRS. In certain embodiments, at least one SOI is located between the first and the third RRS, and at least one SOI is located between the third and the second RRS. In certain embodiments, the first and the second RRS are the same and the third RRS is different from the first or the second RRS. In certain embodiments, all three RRSs are heterospecific. In certain embodiments, SOIs encoding one heavy chain and one light chain of a first antibody are located between the first and the third RRS, and SOIs encoding one heavy chain and one light chain of a second antibody are located between the third and the second RRS. In certain embodiments, SOIs encoding one heavy chain and two light chains of a first antibody are located between the first and the third RRS, and SOIs encoding one heavy chain and one light chain of a second antibody are located between the third RRS and the second RRS. In certain embodiments, SOIs encoding one heavy chain and three light chains of a first antibody are located between the first and the third RRS, and SOIs encoding one light chain of the first antibody and one heavy chain and one light chain of a second antibody are located between the third RRS and the second RRS. In certain embodiments, SOIs encoding one heavy chain and three light chains of a first antibody are located between the first and the third RRS, and SOIs encoding two light chains of the first antibody and one heavy chain and one light chain of a second antibody are located between the third RRS and the second RRS. In certain embodiments, SOIs encoding different combinations of copies of heavy chains and light chains of multiple antibodies are located between the first and the third RRS, and between the third and the second RRS.

In certain embodiments, the number of SOIs is selected to increase the titer and/or specific productivity of the host cells expressing the SOIs. For example, but not by way of limitation, the incorporation of two, three, four, five, six, seven, eight, or more SOIs can result in increased titer and/or specific productivity.

In the context of antibody expression, the inclusion of an additional heavy or light chain encoding SOIs can result in increased titer and/or specific productivity. For example, but not by way of limitation, when increasing copy number from one heavy chain and one light chain (HL) to one heavy chain and two light chain encoding sequences (HLL), an increase in titer and/or specific productivity can be achieved. Similarly, as outlined in the examples below, increasing from HLL (three SOIs) to HLL-HL (five SOIs) or HLL-HLL (six SOIs) can provide for an increase in titer and/or specific productivity. Additionally, increasing copy number to HLL-HL (five SOIs) or HLL-HLHL (seven SOIs) can provide for an increase in titer and/or specific productivity. Additional options for heavy and light chain SOI copy numbers include, but are not limited to HHL; HHL-H; HLL-H; HHL-HH; HHL-HL; HHL-LL; HLL-HH; HLL-HL; HLL-LL; HHL-HHL; HHL-HHH; HHL-HLL; HHK-LLL; HLL-HHL; HLL-HHH; HLL-LLL; HHL-HHHUL; HHL-HHHH; HHL-HHLL; HHL-HLLL; HHL-LLLL; HLL-HHHL; HLL-HHHH; HLL-HLLL; and HLL-LLLL. In certain embodiments, the inclusion of additional copies occurs at a single genomic locus, while in certain embodiments the SOI copies can be integrated at two or more loci, e.g., multiple copies can be integrated at a single locus and one or more copies integrated at one or more additional loci.

In certain embodiments, the position of the SOIs, e.g., whether one SOI is located 3' or 5' relative to another SOI, is selected to increase the titer and/or specific productivity of the host cells expressing the SOIs. For example, but not by way of limitation, in the context of antibody production, the integrated position of heavy and light chain SOIs can result in increased titer and/or specific productivity. As outlined in FIGS. 23A-D and the examples presented below, the relative position of heavy and light chain SOIs can impact the titer and specific productivity, despite no change in SOI copy number.

4. Host Cells

The presently disclosed subject matter provides a host cell suitable for targeted integration of nucleotide sequences and expression of polypeptides of interest. In certain embodiments, a host cell comprises an endogenous gene selected from the group consisting of LOC107977062, LOC100768845, ITPR2, ERE67000.1, UBAP2, MTMR2, XP_003512331.2 and sequences at least 50% homologous thereto, or a locus of the genome of the host cell, wherein the locus comprises a nucleotide sequence that is selected from the group consisting of SEQ ID Nos. 1-7 and sequences at least 50% homologous thereto.

In certain embodiments, a host cell is a eukaryotic host cell. In certain embodiments, a host cell is a mammalian host cell. In certain embodiments, a host cell is a hamster host cell, a human host cell, a rat host cell, or a mouse host cell. In certain embodiments, a host cell is a Chinese hamster ovary (CHO) host cell, a CHO K1 host cell, a CHO K1SV host cell, a DG44 host cell, a DUKXB-11 host cell, a CHOK1S host cell, or a CHO K1M host cell.

In certain embodiments, a host cell is selected from the group consisting of monkey kidney CV1 line transformed by SV40 (COS-7), human embryonic kidney line (293 or 293 cells as described, e.g., in Graham et al., *J Gen Virol.* 36:59 (1977)), baby hamster kidney cells (BHK), mouse sertoli cells (TM4 cells as described, e.g., in Mather, *Biol. Reprod.* 23:243-251 (1980)), monkey kidney cells (CV1), African green monkey kidney cells (VERO-76), human cervical carcinoma cells (HELA), canine kidney cells (MDCK; buffalo rat liver cells (BRL 3A), human lung cells (W138), human liver cells (Hep G2), mouse mammary tumor (MMT 060562), TRI cells, as described, e.g., in Mather et al., *Annals N.Y. Acad. Sci.* 383:44-68 (1982), MRC 5 cells, FS4 cells, YO cells, NSO cells, Sp2/0 cells, and PER.C6® cells.

In certain embodiments, a host cell is a cell line. In certain embodiments, a host cell is a cell line that has been cultured for a certain number of generations. In certain embodiments, a host cell is a primary cell.

In certain embodiments, expression of a polypeptide of interest is stable if the expression level is maintained at certain levels, increases, or decreases less than 20%, over 10, 20, 30, 50, 100, 200, or 300 generations. In certain embodiments, expression of a polypeptide of interest is stable if the culture can be maintained without any selection. In certain embodiments, expression of a polypeptide of interest is high if the polypeptide product of the gene of interest reaches about 1 g/L, about 2 g/L, about 3 g/L, about 4 g/L, about 5 g/L, about 10 g/L, about 12 g/L, about 14 g/L, or about 16 g/L.

The presently disclosed subject matter also relates to a method for producing a polypeptide of interest. In certain embodiments, such method comprises: a) providing a host cell comprising at least one exogenous SOI and at least one selection marker flanked by two RRSs integrated within a locus of the genome of the host cell, wherein the locus is at least about 90% homologous to a sequence selected from SEQ ID Nos. 1-7; and b) culturing the cell in a) under conditions suitable for expressing the SOI and recovering a polypeptide of interest therefrom. In certain embodiments, such method comprises: a) providing a host cell comprising at least two exogenous SOIs and at least one selection marker integrated within a locus of the genome of the host cell, wherein the locus is at least about 90% homologous to a sequence selected from SEQ ID Nos. 1-7, wherein at least one exogenous SOI and one selection marker is flanked by a first and a third RRS and at least one exogenous SOI is flanked by a second and the third RRS; and b) culturing the cell in a) under conditions suitable for expressing the SOI and recovering a polypeptide of interest therefrom. In certain embodiments, such method comprises: a) providing a host cell comprising at least one exogenous SOI and at least one selection marker flanked by two RRSs integrated within an endogenous gene selected from the group consisting of LOC107977062, LOC100768845, ITPR2, ERE67000.1, UBAP2, MTMR2, XP_003512331.2, and at least about 90% homologous sequences thereof, and b) culturing the cell in a) under conditions suitable for expressing the SOI and recovering a polypeptide of interest therefrom. In certain embodiments, such method comprises: a) providing a host cell comprising at least two exogenous SOIs and at least one selection marker integrated within an endogenous gene selected from the group consisting of LOC107977062, LOC100768845, ITPR2, ERE67000.1, UBAP2, MTMR2, XP_003512331.2, and sequences at least about 90% homologous thereto, wherein at least one exogenous SOI and one selection marker is flanked by a first and a third RRS and at least one exogenous SOI is flanked by a second and the third RRS; and b) culturing the cell in a) under conditions suitable for expressing the SOI and recovering a polypeptide of interest therefrom.

In certain embodiments, polypeptide of interest is produced and secreted into the cell culture medium. In certain embodiments, polypeptide of interest is expressed and retained within the host cell. In certain embodiments, polypeptide of interest is expressed, inserted into, and retained in the host cell membrane.

Exogenous nucleotides of interest or vectors can be introduced into a host cell by conventional cell biology methods including, but not limited to, transfection, transduction, electroporation, or injection. In certain embodiments, exogenous nucleotides of interest or vectors are introduced into a host cell by chemical based transfection methods comprising lipid-based transfection method, calcium phosphate-based transfection method, cationic polymer-based transfection method, or nanoparticle-based transfection. In certain embodiments, exogenous nucleotides of interest are introduced into a host cell by virus-mediated transduction including, but not limited to, lentivirus, retrovirus, adenovirus, or adeno-associated virus-mediated transduction. In certain embodiments, exogenous nucleotides of interest or vectors are introduced into a host cell via gene gun-mediated injection. In certain embodiments, both DNA and RNA molecules are introduced into a host cell using methods described herein.

5. Targeted Integration

A targeted integration allows for exogenous nucleotide sequences to be integrated into one or more pre-determined sites of a host cell genome. In certain embodiments, the targeted integration is mediated by a recombinase that recognizes one or more RRSs. In certain embodiments, the targeted integration is mediated by homologous recombination. In certain embodiments, the targeted integration is mediated by an exogenous site-specific nuclease followed by HDR and/or NHEJ.

5.1. Targeted Integration Via Recombinase-Mediated Recombination

A "recombination recognition sequence" (RRS) is a nucleotide sequence recognized by a recombinase and is necessary and sufficient for recombinase-mediated recombination events. A RRS can be used to define the position where a recombination event will occur in a nucleotide sequence.

In certain embodiments, a RRS is selected from the group consisting of a LoxP sequence, a LoxP L3 sequence, a LoxP 2 L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a φC31 attP sequence, and a φC31 attB sequence.

In certain embodiments, a RRS can be recognized by a Cre recombinase. In certain embodiments, a RRS can be recognized by a FLP recombinase. In certain embodiments, a RRS can be recognized by a Bxb1 integrase. In certain embodiments, a RRS can be recognized by a φC31 integrase.

In certain embodiments when the RRS is a LoxP site, the host cell requires the Cre recombinase to perform the recombination. In certain embodiments when the RRS is a FRT site, the host cell requires the FLP recombinase to perform the recombination. In certain embodiments when the RRS is a Bxb1 attP or a Bxb1 attB site, the host cell requires the Bxb1 integrase to perform the recombination. In certain embodiments when the RRS is a φC31 attP or a φC31attB site, the host cell requires the φC31 integrase to perform the recombination. The recombinases can be introduced into a host cell using an expression vector comprising coding sequences of the enzymes.

The Cre-LoxP site-specific recombination system has been widely used in many biological experimental systems. Cre is a 38-kDa site-specific DNA recombinase that recognizes 34 bp LoxP sequences. Cre is derived from bacteriophase P1 and belongs to the tyrosine family site-specific recombinase. Cre recombinase can mediate both intra and intermolecular recombination between LoxP sequences. The LoxP sequence is composed of an 8 bp nonpalindromic core region flanked by two 13 bp inverted repeats. Cre recombinase binds to the 13 bp repeat thereby mediating recombination within the 8 bp core region. Cre-LoxP-mediated recombination occurs at a high efficiency and does not require any other host factors. If two LoxP sequences are placed in the same orientation on the same nucleotide sequence, Cre-mediated recombination will excise DNA sequences located between the two LoxP sequences as a covalently closed circle. If two LoxP sequences are placed in an inverted position on the same nucleotide sequence, Cre-mediated recombination will invert the orientation of the DNA sequences located between the two sequences. LoxP sequences can also be placed on different chromosomes to facilitate recombination between different chromosomes. If two LoxP sequences are on two different DNA molecules and if one DNA molecule is circular, Cre-mediated recombination will result in integration of the circular DNA sequence.

In certain embodiments, a LoxP sequence is a wild-type LoxP sequence. In certain embodiments, a LoxP sequence is a mutant LoxP sequence. Mutant LoxP sequences have been developed to increase the efficiency of Cre-mediated integration or replacement. In certain embodiments, a mutant LoxP sequence is selected from the group consisting of a LoxP L3 sequence, a LoxP 2 L sequence, a LoxFas sequence, a Lox511 sequence, a Lox2272 sequence, a Lox2372 sequence, a Lox5171 sequence, a Loxm2 sequence, a Lox71 sequence, and a Lox66 sequence. For example, the Lox71 sequence has 5 bp mutated in the left 13 bp repeat. The Lox66 sequence has 5 bp mutated in the right 13 bp repeat. Both the wild-type and the mutant LoxP sequences can mediate Cre-dependent recombination.

The FLP-FRT site-specific recombination system is similar to the Cre-Lox system. It involves the flippase (FLP) recombinase, which is derived from the 2 μm plasmid of the yeast *Saccharomyces cerevisiae*. FLP also belongs to the tyrosine family site-specific recombinase. The FRT sequence is a 34 bp sequence that consists of two palindromic sequences of 13 bp each flanking an 8 bp spacer. FLP binds to the 13 bp palindromic sequences and mediates DNA break, exchange and ligation within the 8 bp spacer. Similar to the Cre recombinase, the position and orientation of the two FRT sequences determine the outcome of FLP-mediated recombination. In certain embodiments, a FRT sequence is a wild-type FRT sequence. In certain embodiments, a FRT sequence is a mutant FRT sequence. Both the wild-type and the mutant FRT sequences can mediate FLP-dependent recombination. In certain embodiments, a FRT sequence is fused to a responsive receptor domain sequence, such as, but not limited to, a tamoxifen responsive receptor domain sequence.

Bxb1 and φpC31 belong to the serine recombinase family. They are both derived from bacteriophages and are used by these bacteriophages to establish lysogeny to facilitate site-specific integration of the phage genome into the bacterial genome. These integrases catalyze site-specific recombination events between short (40-60 bp) DNA substrates termed attP and attB sequences that are originally attachment sites located on the phage DNA and bacterial DNA, respectively. After recombination, two new sequences are formed, which are termed attL and attR sequences and each contains half sequences derived from attP and attB. Recombination can also occur between attL and attR sequences to excise the integrated phage out of the bacterial DNA. Both integrases can catalyze the recombination without the aid of any additional host factors. In the absence of any accessory factors, these integrases mediate unidirectional recombination between attP and attB with greater than 80% efficiency. Because of the short DNA sequences that can be recognized by these integrases and the unidirectional recombination, these recombination systems have been developed as a complement to the widely-used Cre-LoxP and FRT-FLP systems for genetic engineering purposes.

The terms "matching RRSs" and "homospecific RRSs" indicates that a recombination occurs between two RRSs. In certain embodiments, the two matching RRSs are the same. In certain embodiments, both RRSs are wild-type LoxP sequences. In certain embodiments, both RRSs are mutant LoxP sequences. In certain embodiments, both RRSs are wild-type FRT sequences. In certain embodiments, both RRSs are mutant FRT sequences. In certain embodiments, the two matching RRSs are different sequences but can be recognized by the same recombinase. In certain embodiments, the first matching RRS is a Bxb1 attP sequence and the second matching RRS is a Bxb1 attB sequence. In certain embodiments, the first matching RRS is a pC31 attB sequence and the second matching RRS is a pC31 attB sequence.

In certain embodiments, an integrated exogenous nucleotide sequence comprises two RRSs and a vector comprises two RRSs matching the two RRSs on the integrated exogenous nucleotide sequence, i.e., the first RRS on the integrated exogenous nucleotide sequence matches the first RRS on the vector and the second RRS on the integrated exogenous nucleotide sequence matches the second RRS on the vector. In certain embodiments, the first RRS on the integrated exogenous nucleotide sequence and the first RRS on the vector are the same as the second RRS on the integrated exogenous nucleotide sequence and the second RRS on the vector. A non-limiting example of such a "single-vector RMCE" strategy is presented in FIG. 2A. In certain embodiments, the first RRS on the integrated exogenous nucleotide sequence and the first RRS on the vector are different from the second RRS on the integrated exogenous nucleotide sequence and the second RRS on the vector. In certain embodiments, the first RRS on the integrated exogenous nucleotide sequence and the first RRS on the vector are both LoxP L3 sequences, and the second RRS on the integrated exogenous nucleotide sequence and the second RRS on the vector are both LoxP 2 L sequences.

Figure 4:
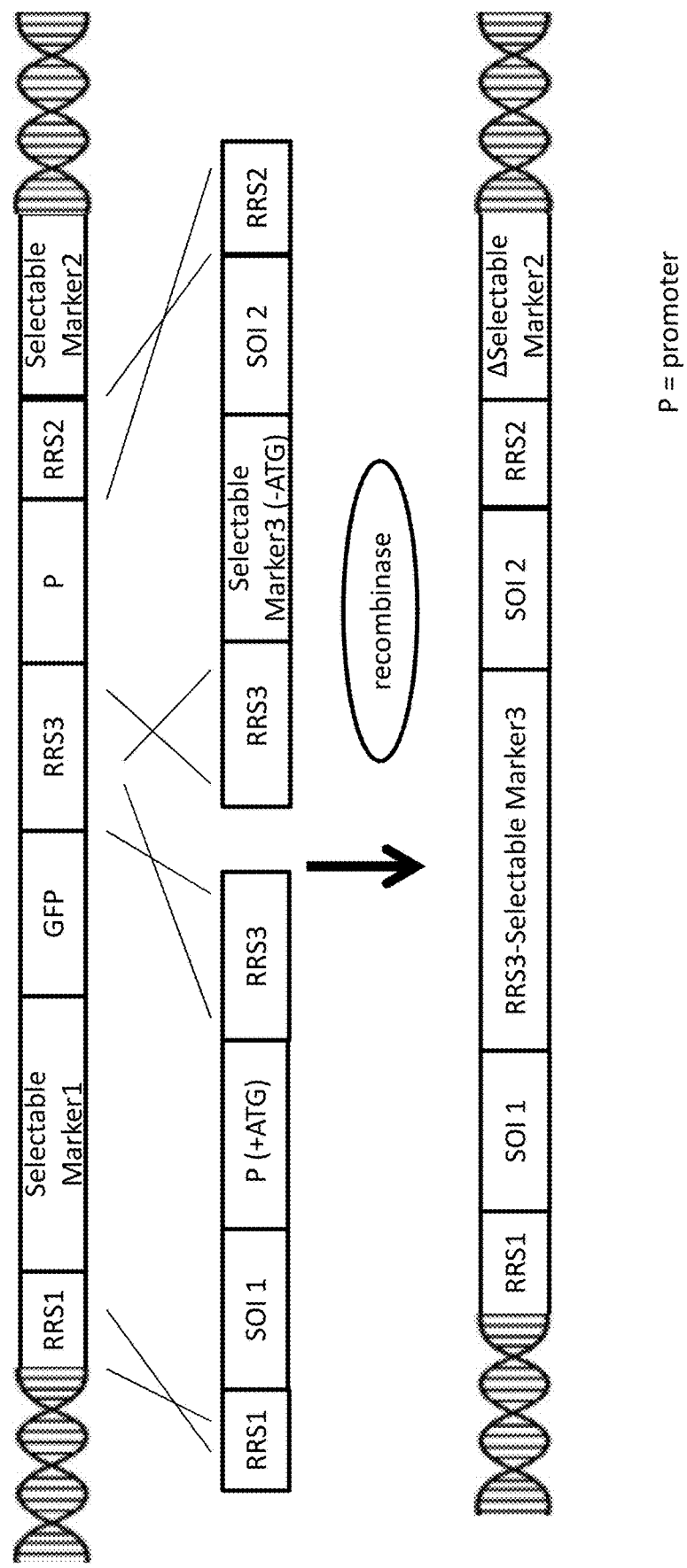
FIG. 4 depicts a two-plasmid RMCE strategy involving the use of three RRS sites to carry out two independent RMCEs simultaneously. One vector (front) comprises the RRS1, a first SOI and a promoter (P) followed by a start codon (ATG) and RRS3. The other vector (back) comprises the RRS3 fused to the coding sequence of a marker without the start codon (ATG), an SOI 2 and the RRS2. Only when the two plasmids are correctly targeted will the full expression cassette of the selection marker be assembled thus rendering cells resistance to selection.

In certain embodiments, a "two-vector RMCE" strategy is employed. For example, but not by way of limitation, an integrated exogenous nucleotide sequence could comprise three RRSs, e.g., an arrangement where the third RRS ("RRS3") is present between the first RRS ("RRS1") and the second RRS ("RRS2"), while a first vector comprises two RRSs matching the first and the third RRS on the integrated exogenous nucleotide sequence, and a second vector comprises two RRSs matching the third and the second RRS on the integrated exogenous nucleotide sequence. An example of a two vector RMCE strategy is illustrated in FIG. 4. In such an example, RRS1, RRS2, and RRS3 are heterospecific, e.g., they do not cross-react with each other. In some embodiments, one vector (front) comprises the RRS1, a first SOI and a promoter followed by a start codon and RRS3 (in this order). The other vector (back) comprises the RRS3 fused to the coding sequence of a marker without the start codon (ATG), an SOI 2 and the RRS2 (in this order). Additional nucleotides may be inserted between the RRS3 site and the selection marker sequence to ensure in frame translation for the fusion protein. In some embodiments, the first SOI encodes an antibody. In some embodiments, the antibody is a single chain antibody, an antibody light chain, an antibody heavy chain, a single-chain Fv fragment (scFv), or an Fc fusion protein. In some embodiments, the second SOI encodes an antibody. In some embodiments, the antibody is a single chain antibody, an antibody light chain, an antibody heavy chain, a single-chain Fv fragment (scFv), or an Fc fusion protein. In certain embodiments the antibodies encoded by the first and second SOIs pair to form a multispecific, e.g., bispecific antibody.

Such two vector RMCE strategies allow for the introduction of eight or more SOIs by incorporating the appropriate number of SOIs between each pair of RRSs.

Both single-vector and two-vector RMCE allow for unidirectional integration of one or more donor DNA molecule (s) into a pre-determined site of a host cell genome, and precise exchange of a DNA cassette present on the donor DNA with a DNA cassette on the host genome where the integration site resides. The DNA cassettes are characterized by two heterospecific RRSs flanking at least one selection marker (although in certain two-vector RMCE examples a "split selection marker" can be used as outlined herein) and/or at least one exogenous SOI. RMCE involves double recombination cross-over events, catalyzed by a recombinase, between the two heterospecific RRSs within the target genomic locus and the donor DNA molecule. RMCE is designed to introduce a copy of the SOI or selection marker into the pre-determined locus of a host cell genome. Unlike recombination which involves just one cross-over event, RMCE can be implemented such that prokaryotic vector sequences are not introduced into the host cell genome, thus reducing and/or preventing unwanted triggering of host immune or defense mechanisms. The RMCE procedure can be repeated with multiple DNA cassettes.

In certain embodiments, targeted integration is achieved by one cross-over recombination event, wherein one exogenous nucleotide sequence comprising one RRS adjacent to at least one exogenous SOI or at least one selection marker is integrated into a pre-determined site of a host cell genome. In certain embodiments, targeted integration is achieved by one RMCE, wherein a DNA cassette comprising at least an exogenous SOI or at least one selection marker flanked by two heterospecific RRSs is integrated into a pre-determined site of a host cell genome. In certain embodiments, targeted integration is achieved by two RMCEs, wherein two different DNA cassettes, each comprising at least an exogenous SOI or at least one selection marker flanked by two heterospecific RRSs, are both integrated into a pre-determined site of a host cell genome. In certain embodiments, targeted integration is achieved by multiple RMCEs, wherein DNA cassettes from multiple vectors, each comprising at least an exogenous SOI or at least one selection marker flanked by two heterospecific RRSs, are all integrated into a pre-determined site of a host cell genome. In certain embodiments the selection marker can be partially encoded on the first the vector and partially encoded on the second vector such that the integration of both RMCEs allows for the expression of the selection marker. An example of such a system is presented in FIG. 4.

In certain embodiments, targeted integration via recombinase-mediated recombination leads to a selection marker or one or more exogenous SOI integrated into one or more pre-determined integration sites of a host cell genome along with sequences from a prokaryotic vector. In certain embodiments, targeted integration via recombinase-mediated recombination leads to selection marker or one or more exogenous SOI integrated into one or more pre-determined integration sites of a host cell genome free of sequences from a prokaryotic vector.

5.2 Targeted Integration Via Homologous Recombination, HDR, or NHEJ

The presently disclosed subject matter also relates to targeted integration mediated by homologous recombination or by an exogenous site-specific nuclease followed by HDR or NHEJ.

Homologous recombination is a recombination between DNA molecules that share extensive sequence homology. It can be used to direct error-free repair of double-stranded DNA breaks and generates sequence variation in gametes during meiosis. Since homologous recombination involves the exchange of genetic information between two homologous DNA molecules, it does not alter the overall arrangement of the genes on a chromosome. During homologous recombination, a nick or break forms in double-stranded DNA (dsDNA), followed by the invasion of a homologous dsDNA molecule by a single-stranded DNA end, pairing of homologous sequences, branch migration to form a Holliday junction, and final resolution of the Holliday junction.

Double-strand break (DSB) is the most severe form of DNA damage and repair of such DNA damage is essential for the maintenance of genome integrity in all organisms. There are two major repair pathways to repair DSBs. The first repair pathway is homology-directed repair (HDR) pathway and homologous recombination is the most common form of HDR. Since HDR requires the presence of homologous DNA present in the cell, this repair pathway is normally active in S and G2 phase of the cell cycle wherein newly replicated sister chromatids are available as homologous templates. HDR is also a major repair pathway to repair collapsed replication forks during DNA replication. HDR is considered as a relatively error-free repair pathway. The second repair pathway for DSBs is non-homologous end joining (NHEJ). NHEJ is a repair pathway wherein the ends of a broken DNA are ligated together without the requirement for a homologous DNA template.

Targeted integration can be facilitated by exogenous site-specific nucleases followed by HDR. This is due to that the frequency of homologous recombination can be increased by introducing a DSB at a specific target genomic site. In certain embodiments, an exogenous nuclease can be selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

CRISPR/Cas and TALEN systems are two genome editing tools that offer the best ease of construction and high efficiency. CRISPR/Cas was identified as an immune defense mechanism of bacteria against invading bacteriophages. Cas is a nuclease that, when guided by a synthetic guide RNA (gRNA), is capable of associating with a specific nucleotide sequence in a cell and editing the DNA in or around that nucleotide sequence, for instance by making one or more of a single-strand break, a DSB, and/or a point mutation. TALEN is an engineered site-specific nuclease, which is composed of the DNA-binding domain of TALE (transcription activator-like effectors) and the catalytic domain of restriction endonuclease FokI. By changing the amino acids present in the highly variable residue region of the monomers of the DNA binding domain, different artificial TALENs can be created to target various nucleotides sequences. The DNA binding domain subsequently directs the nuclease to the target sequences and creates a DSB.

Targeted integration via homologous recombination or HDR involves the presence of homologous sequences to the integration site. In certain embodiments, the homologous sequences are present on a vector. In certain embodiments, the homologous sequences are present on a polynucleotide.

In certain embodiments, a vector for targeted integration of exogenous nucleotide sequences into a host cell comprises nucleotide sequences homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7 flanking at least one selection marker. In certain embodiments, a vector for targeted integration of exogenous nucleotide sequences into a host cell comprises nucleotide sequences homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7 flanking at least one selection marker and at least one exogenous SOI. In certain embodiments, a vector for targeted integration of exogenous nucleotide sequences into a host cell comprises nucleotide sequences at least 50% homologous to a sequence selected from SEQ ID Nos. 1-7 flanking a DNA cassette, wherein the DNA cassette comprises at least one selection marker and at least one exogenous SOI flanked by two RRSs. In certain embodiments, a vector for targeted integration of exogenous nucleotide sequences into a host cell comprises nucleotide sequences at least 50% homologous to an endogenous gene selected from the group consisting of LOC107977062, LOC100768845, ITPR2, ERE67000.1, UBAP2, MTMR2, and XP_003512331.2 flanking a DNA cassette, wherein the DNA cassette comprises at least one selection marker and at least one exogenous SOI flanked by two RRSs. In certain embodiments, the vector nucleotide sequences are at least about 50%, at least about 60%, at least about 70%, at least about 80%, at least about 90%, at least about 95%, at least about 99%, or at least about 99.9% homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7. In certain embodiments, the vector is selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid.

In certain embodiments, a polynucleotide for targeted integration of exogenous nucleotide sequences into a host cell comprises nucleotide sequences homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7 flanking at least one selection marker. In certain embodiments, a polynucleotide for targeted integration of exogenous nucleotide sequences into a host cell comprises nucleotide sequences homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7 flanking at least one selection marker and at least one exogenous SOI. In certain embodiments, a polynucleotide for targeted integration of exogenous nucleotide sequences into a host cell comprises nucleotide sequences at least 50% homologous to a sequence selected from SEQ ID Nos. 1-7 flanking a DNA cassette, wherein the DNA cassette comprises at least one selection marker and at least one exogenous SOI flanked by two RRSs. In certain embodiments, a polynucleotide for targeted integration of exogenous nucleotide sequences into a host cell comprises nucleotide sequences at least 50% homologous to an endogenous gene selected from the group consisting of LOC107977062, LOC100768845, ITPR2, ERE67000.1, UBAP2, MTMR2, and XP_003512331.2 flanking a DNA cassette, wherein the DNA cassette comprises at least one selection marker and at least one exogenous SOI flanked by two RRSs. In certain embodiments, the flanking nucleotide sequences are at least about 50%, at least about 60%, at least about 70%, at least about 80%, at least about 90%, at least about 95%, at least about 99%, or at least about 99.9% homologous to an endogenous gene selected from the group consisting of LOC107977062, LOC100768845, ITPR2, ERE67000.1, UBAP2, MTMR2, and XP_003512331.2, or to a sequence selected from SEQ ID Nos. 1-7.

In certain embodiments, homologous recombination is carried out without any accessory factors. In certain embodiments, homologous recombination is facilitated by the presence of vectors that are capable of integration. In certain embodiments, an integrating vector is selected from the group consisting of an adeno-associated virus vector, a lentivirus vector, a retrovirus vector, and an integrating phage vector.

5.3 Regulated Targeted Integration

There are many cases where protein expression levels are not optimal mainly because the encoded proteins are difficult-to-express. The low expression level of difficult-to-express proteins can have diverse and difficult to identify causes. One possibility is the toxicity of the expressed proteins in the host cells. In such cases, a regulated expression system can be used to express toxic proteins where the sequences of interest encoding the proteins are under the control of an inducible promoter. In these systems, expression of the difficult-to-express proteins is only prompted when a regulator, e.g., small molecule, such as, but not limited to, tetracycline or its analogue, doxycycline (DOX), is added to the culture. Regulating the expression of toxic proteins could alleviate the toxic effects, allowing the cultures to achieve the desired cell growth prior to production. In certain embodiments, a regulated target integration (RTI) system comprises a SOI that is integrated into a specific locus, e.g., an exogenous nucleic acid sequence comprising one or more RRSs, and is transcribed under a regulated promoter operably linked thereto. In certain embodiments, an RTI system can be used to determine the underlying causes of low protein expression for a difficult-to-express molecule, such as, but not limited to, an antibody. In certain embodiments, the ability to selectively turn off the expression of a SOI in an RTI system can be used to link expression of a SOI to an observed adverse effect.

In certain embodiments, to minimize transcriptional and cell line variability effects during the root cause analysis of difficult-to-express molecules, a regulated target integration (RTI) system can be used. For example, but not by way of limitation, the expression of the SOI in a TI host can be triggered by addition to the culture of a regulator, e.g., doxycycline. In certain embodiments, the RTI vector utilizes a tetracycline-regulated promoter to express the SOI, which can be integrated into, e.g., an exogenous nucleic acid sequence comprising an RRS, which is itself integrated into an integration site in the host cell's genome, allowing for regulated expression of the SOI.

In certain embodiments, the RTI system described in the present disclosure can be used to successfully determine the underlying cause(s) of low protein expression of an SOI, e.g., a therapeutic antibody, as compared to control cell line. In certain embodiments, once the lower relative expression of a SOI, e.g., a therapeutic antibody, in a RTI cell line is confirmed, the intracellular accumulation and secretion levels of the SOI can be evaluated by leveraging protein translation inhibitor treatments, e.g., Dox and cycloheximide.

5.4 Regulated Systems

The presently disclosed subject matter also relates to regulated systems for use in TI. For example, but not by way limitation, such regulation can be based on gene switches for blocking or activating mRNA synthesis by regulated coupling of transcriptional repressors or activators to constitutive or minimal promoters. In certain non-limiting embodiments, repression can be achieved by binding the repressor proteins, e.g., where the proteins sterically block transcriptional initiation, or by actively repressing transcription through transcriptional silencers. In certain non-limiting embodiments, activation of mammalian or viral enhancer-less minimal promoters can be achieved by the regulated coupling to an activation domain.

In certain embodiments, the conditional coupling of transcriptional repressors or activators can be achieved by using allosteric proteins that bind the promoters in response to external stimuli. In certain embodiments, the conditional coupling of transcriptional repressors or activators can be achieved by using intracellular receptors that are released from sequestrating proteins and, thus, can bind target promoters. In certain embodiments, the conditional coupling of transcriptional repressors or activators can be achieved by using chemically induced dimerizers.

In certain embodiments, the allosteric proteins used in the TI systems of the present disclosure can be proteins that modulate transcriptional activity in response to antibiotics, bacterial quorum-sensing messengers, catabolites, or to the cultivation parameters, such as temperature, e.g. cold or heat. In certain embodiments, such RTI systems can be catabolite-based, e.g., where a bacterial repressor that controls catabolic genes for alternative carbon sources has been transferred to mammalian cells. In certain embodiments, the repression of the target promoter can be achieved by cumate-responsive binding of the repressor CymR. In certain embodiments, the catabolite-based system can rely on the activation of chimeric promoters by 6-hydroxynicotine-responsive binding of the prokaryotic repressor HdnoR, fused to the Herpes simplex VP16 transactivation domain.

In certain embodiments the TI system can be a quorum-sensing-based expression system originated from prokaryotes that manage intra- and inter-population communication by quorum-sensing molecules. These quorum-sensing molecules bind to receptors in target cells, modulate the receptors' affinity to cognate promoters leading to the initiation of specific regulon switches. In certain embodiments, the quorum-sensing molecule can be the N-(3-oxo-octanoyl)-homoserine lactone in the presence of which, the TraR-p65 fusion protein activates expression from a minimal promoter fused to the TraR-specific operator sequence. In certain embodiments, the quorum-sensing molecule can be the butyrolactone SCB1 (racemic 2-(1'-hydroxy-6-methylheptyl)-3-(hydroxymethyl)-butanolide) in a system based on the *Streptomyces coelicolor* A3(2) ScbR repressor that binds its cognate operator OScbR in the absence of the SCB1. In certain embodiments, the quorum-sensing molecule can be homoserine-derived inducers used in a RTI system wherein *Pseudomonas aeruginosa* quorum-sensing repressors Rh1R and LasR are fused to the SV40 T-antigen nuclear localization sequence and the Herpes simplex VP16 domain and can activate promoters containing specific operator sequences (las boxes).

In certain embodiments, the inducing molecules that modulate the allosteric proteins used in the RTI systems of the present disclosure can be, but are not limited to, cumate, isopropyl-β-D-galactopyranoside (IPTG), macrolides, 6-hydroxynicotine, doxycycline, streptogramins, NADH, tetracycline.

In certain embodiments, the intracellular receptors used in the RTI systems of the present disclosure can be cytoplasmic or nuclear receptors. In certain embodiments, the RTI systems of the present disclosure can utilize the release of transcription factors from sequestering and inhibiting proteins by using small molecules. In certain embodiments, the RTI systems of the present disclosure can rely on steroid-regulation, wherein a hormone receptor is fused to a natural or an artificial transcription factor that can be released from HSP90 in the cytosol, migrate into the nucleus and activate selected promoters. In certain embodiments, mutant receptors can be used that are regulated by synthetic steroid analogs in order to avoid crosstalk by endogenous steroid hormones. In certain embodiments the receptors can be an estrogen receptor variant responsive to 4-hydroxytamoxifen or a progesterone-receptor mutant inducible by RU486. In certain embodiments, the nuclear receptor-derived rosiglitazone-responsive transcription switch based on the human nuclear peroxisome proliferator-activated receptor γ(PPARγ) can be used in the RTI systems of the present disclosure. In certain embodiments, a variant of steroid-responsive receptors can be the RheoSwitch, that is based on a modified *Choristoneura fumiferana* ecdysone receptor and the mouse retinoid X receptor (RXR) fused to the Gal4 DNA binding domain and the VP16 trans-activator. In the presence of synthetic ecdysone, the RheoSwitch variant can bind and activate a minimal promoter fused to several repeats of the Gal4-response element.

In certain embodiments, the RTI systems disclosed herein can utilize chemically induced dimerization of a DNA-binding protein and a transcriptional activator for the activation of a minimal core promoter fused with a cognate operator. In certain embodiments, the RTI systems disclosed herein can utilize the rapamycin-regulated dimerization of FKBP with FRB. In this system the FRB is fused to the p65 trans-activator and FKBP is fused to a zinc finger domain specific for cognate operator sites placed upstream of an engineered minimal interleukin-12 promoter. In certain embodiments, the FKBP can be mutated. In certain embodiments, the RTI systems disclosed herein can utilize bacterial gyrase B subunit (GyrB), where GyrB dimerizes in the presence of the antibiotic coumermycin and dissociates with novobiocin.

In certain embodiments, the RTI systems of the present disclosure can be used for regulated siRNA expression. In certain embodiments, the regulated siRNA expression system can be a tetracycline, a macrolide, or an OFF- and ON-type QuoRex system. In certain embodiments, the RTI system can utilize a Xenopus terminal oligopyrimidine element (TOP), which blocks translational initiation by forming hairpin structures in the 5' untranslated region.

In certain embodiments, the RTI systems described in the present disclosure can utilize gas-phase controlled expression, e.g., acetaldehyde-induced regulation (AIR) system. The AIR system can employ the *Aspergillus nidulans* AlcR transcription factor, which specifically activates the PAIR promoter assembled from AlcR-specific operators fused to the minimal human cytomegalovirus promoter in the presence of gaseous or liquid acetaldehyde at nontoxic concentrations.

In certain embodiments, the RTI systems of the present disclosure can utilize a Tet-On or a Tet-Off system. In such systems, expression of a one or more SOIs can be regulated by tetracycline or its analogue, doxycycline.

In certain embodiments, the RTI system of the present disclosure can utilize a PIP-on or a PIP-off system. In such systems, the expression of SOIs can be regulated by, e.g., pristinamycin, tetracycline and/or erythromycin.

6. Preparation and Use of TI Host Cells

The presently disclosed subject matter relates to methods for the targeted integration of exogenous nucleotide sequences into a host cell. In certain embodiments, the methods relate to the integration of an exogenous nucleotide sequence into a host cell to produce a host cell suitable for subsequent targeted integration of a SOI. In certain embodiments, said methods comprise recombinase-mediated recombination. In certain embodiments, said methods involve homologous recombination, HDR, and/or NHEJ.

6.1 Preparation of TI Host Cells Using Recombinase-Mediated Recombination

In certain embodiments, the present disclosure provides methods for preparing TI host cells to express a polypeptide of interest comprising: a) providing a TI host cell comprising an exogenous nucleotide sequence integrated at a site within a locus of the genome of the host cell, wherein the locus is at least about 90% homologous to SEQ ID Nos. 1-7, wherein the exogenous nucleotide sequence comprises two RRSs, flanking at least one first selection marker; b) introducing into the cell provided in a) a vector comprising two RRSs matching the two RRSs on the integrated exogenous nucleotide sequence and flanking at least one exogenous SOI and at least one second selection marker; c) introducing a recombinase, wherein the recombinase recognizes the RRSs; and d) selecting for TI cells expressing the second selection marker to thereby isolate a TI host cell expressing the polypeptide of interest.

In certain embodiments, the present disclosure provides methods for preparing TI host cells to express a polypeptide of interest comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and at least about 90% homologous sequences thereof, wherein the exogenous nucleotide sequence comprises two RRSs, flanking at least one first selection marker; b) introducing into the cell provided in a) a vector comprising two RRSs matching the two RRSs on the integrated exogenous nucleotide sequence and flanking at least one exogenous SOI and at least one second selection marker; c) introducing a recombinase, wherein the recombinase recognizes the RRSs; and d) selecting for TI cells expressing the second selection marker to thereby isolate a TI host cell expressing the polypeptide of interest.

In certain embodiments, the present disclosure provides methods for preparing TI host cells to express a polypeptide of interest comprising: a) providing a TI host cell comprising an exogenous nucleotide sequence integrated at a site within a locus of the genome of the TI host cell, wherein the locus is at least about 90% homologous to SEQ ID Nos. 1-7, wherein the exogenous nucleotide sequence comprises a first DNA cassette comprising two heterospecific RRSs, flanking at least one first selection marker; b) introducing into the cell provided in a) a vector comprising a second DNA cassette comprising two heterospecific RRSs matching the two RRSs on the integrated exogenous nucleotide sequence and flanking at least one exogenous SOI and at least one second selection marker; c) introducing a recombinase, wherein the recombinase recognizes the RRSs and performs one RMCE; and d) selecting for TI cells expressing the second selection marker to thereby isolate a TI host cell expressing the polypeptide of interest.

In certain embodiments, the present disclosure provides methods for preparing TI host cells to express a polypeptide of interest comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and at least about 90% homologous sequences thereof, wherein the exogenous nucleotide sequence comprises a first DNA cassette comprising two heterospecific RRSs, flanking at least one first selection marker; b) introducing into the cell provided in a) a vector comprising a second DNA cassette comprising two heterospecific RRSs matching the two RRSs on the integrated exogenous nucleotide sequence and flanking at least one exogenous SOI and at least one second selection marker; c) introducing a recombinase, wherein the recombinase recognizes the RRSs and performs one RMCE; and d) selecting for TI cells expressing the second selection marker to thereby isolate a TI host cell expressing the polypeptide of interest.

In certain embodiments, the present disclosure provides methods for preparing TI host cells to express a first and second polypeptide of interest (where the first and second polypeptides can be the same or different) comprising: a) providing a TI host cell comprising an exogenous nucleotide sequence integrated at a site within a locus of the genome of the host cell, wherein the locus is at least about 90% homologous to SEQ ID Nos. 1-7, wherein the exogenous nucleotide sequence comprises a first and a second RRS flanking at least one first selection marker, and a third RRS located between the first and the second RRS, and all the RRSs are heterospecific; b) introducing into the cell provided in a) a first vector comprising two RRSs matching the first and the third RRS on the integrated exogenous nucleotide sequence and flanking at least one first exogenous SOI and at least one second selection marker; c) introducing into the cell provided in a) a second vector comprising two RRSs matching the second and the third RRS on the integrated exogenous nucleotide sequence and flanking at least one second exogenous SOI; d) introducing one or more recombinases, wherein the one or more recombinases recognize the RRSs; and e) selecting for TI cells expressing the second selection marker to thereby isolate a TI host cell expressing the first and second polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

In certain embodiments, the present disclosure provides methods for preparing TI host cells to express a first and second polypeptide of interest (where the first and second polypeptides can be the same or different) comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and at least about 90% homologous sequences thereof, wherein the exogenous nucleotide sequence comprises a first and a second RRS flanking at least one first selection marker, and a third RRS located between the first and the second RRS, and all the RRSs are heterospecific; b) introducing into the cell provided in a) a first vector comprising two RRSs matching the first and the third RRS on the integrated exogenous nucleotide sequence and flanking at least one first exogenous SOI and at least one second selection marker; c) introducing into the cell provided in a) a second vector comprising two RRSs matching the second and the third RRS on the integrated exogenous nucleotide sequence and flanking at least one second exogenous SOI; d) introducing one or more recombinases, wherein the one or more recombinases recognize the RRSs; and e) selecting for TI cells expressing the second selection marker to thereby isolate a TI host cell expressing the first and second polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

In certain embodiments, the present disclosure provides methods for preparing TI host cells to express a first and second polypeptide of interest (where the first and second polypeptides can be the same or different) comprising: a) providing a TI host cell comprising an exogenous nucleotide sequence integrated at a site within a locus of the genome of the host cell, wherein the locus is at least about 90% homologous to SEQ ID Nos. 1-7, wherein the exogenous nucleotide sequence comprises a first DNA cassette comprising a first and a second RRS flanking at least one first selection marker, and a third RRS located between the first and the second RRS, and all three RRSs are heterospecific; b) introducing into the cell provided in a) a first vector comprising a second DNA cassette, wherein the second DNA cassette comprises two heterospecific RRSs matching the first and the third RRS of the first DNA cassette and flanking at least one first exogenous SOI and at least one second selection marker; c) introducing into the cell provided in a) a second vector comprising a third DNA cassette, wherein the third DNA cassette comprises two heterospecific RRSs matching the second and the third RRS of the first DNA cassette and flanking at least one second exogenous SOI; d) introducing one or more recombinases, wherein the one or more recombinases recognize the RRSs and perform two RMCEs; and e) selecting for TI cells expressing the second selection marker to thereby isolate a TI host cell expressing the first and second polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

In certain embodiments, the present disclosure provides methods for preparing TI host cells to express a first and second polypeptide of interest (where the first and second polypeptides can be the same or different) comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and sequences at least about 90% homologous thereto, wherein the exogenous nucleotide sequence comprises a first DNA cassette comprising a first and a second RRS flanking at least one first selection marker, and a third RRS located between the first and the second RRS, and all three RRSs are heterospecific; b) introducing into the cell provided in a) a first vector comprising a second DNA cassette, wherein the second DNA cassette comprises two heterospecific RRSs matching the first and the third RRS of the first DNA cassette and flanking at least one first exogenous SOI and at least one second selection marker; c) introducing into the cell provided in a) a second vector comprising a third DNA cassette, wherein the third DNA cassette comprises two heterospecific RRSs matching the second and the third RRS of the first DNA cassette and flanking at least one second exogenous SOI; d) introducing one or more recombinases, wherein the one or more recombinases recognize the RRSs and perform two RMCEs; and e) selecting for TI cells expressing the second selection marker to thereby isolate a TI host cell expressing the first and second polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

In certain embodiments, the present disclosure provides methods for preparing TI host cells to express a polypeptide of interest comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises one RRS adjacent to at least one first selection marker; b) introducing into the cell provided in a) a vector comprising one RRS matching the RRS on the integrated exogenous nucleotide sequence and adjacent to at least one exogenous SOI and at least one second selection marker; c) introducing a recombinase, wherein the recombinase recognizes the RRSs; and d) selecting for TI cells expressing the second selection marker to thereby isolate a TI host cell expressing the polypeptide of interest.

In certain embodiments, the present disclosure provides methods for preparing TI host cells to express a polypeptide of interest comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and sequences at least about 90% homologous thereto, wherein the exogenous nucleotide sequence comprises one RRS adjacent to at least one first selection marker; b) introducing into the cell provided in a) a vector comprising one RRS matching the RRS on the integrated exogenous nucleotide sequence and adjacent to at least one exogenous SOI and at least one second selection marker; c) introducing a recombinase, wherein the recombinase recognizes the RRSs; and d) selecting for TI cells expressing the second selection marker to thereby isolate a TI host cell expressing the polypeptide of interest.

The presently disclosed subject matter also relates to methods of producing a polypeptide of interest comprising: a) providing a TI host cell described herein; b) culturing the TI host cell in a) under conditions suitable for expressing the SOI and recovering a polypeptide of interest therefrom.

In certain embodiments, the present disclosure provides methods for preparing TI host cells suitable for subsequent targeted integration comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises two RRSs flanking at least one exogenous SOI and at least one first selection marker; b) introducing into the cell provided in a) a vector comprising two RRSs matching the two RRSs on the integrated exogenous nucleotide sequence and flanking at least one second selection marker; c) introducing a recombinase, wherein the recombinase recognizes the RRSs; and d) selecting for TI cells expressing the second selection marker to thereby isolate a TI host cell suitable for subsequent targeted integration.

In certain embodiments, the present disclosure provides methods for preparing TI host cells suitable for subsequent targeted integration comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and sequences at least about 90% homologous thereto, wherein the exogenous nucleotide sequence comprises two RRSs flanking at least one exogenous SOI and at least one first selection marker; b) introducing into the cell provided in a) a vector comprising two RRSs matching the two RRSs on the integrated exogenous nucleotide sequence and flanking at least one second selection marker; c) introducing a recombinase, wherein the recombinase recognizes the RRSs; and d) selecting for TI cells expressing the second selection marker to thereby isolate a TI host cell suitable for subsequent targeted integration.

In certain embodiments, the present disclosure provides methods for preparing TI host cells suitable for subsequent targeted integration comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first and a second RRS flanking at least one exogenous SOI and at least one first selection marker; b) introducing into the cell provided in a) a vector comprising three RRSs, wherein the first RRS of the vector matches the first RRS on the integrated exogenous nucleotide sequence, the second RRS of the vector matches the second RRS on the integrated exogenous nucleotide sequence, and at least one second selection marker located between the first and the second RRS; c) introducing a recombinase, wherein the recombinase recognizes the first and the second RRS on both the vector and the integrated exogenous nucleotide sequence; and d) selecting for TI host cells expressing the second selection marker to thereby isolate a TI host cell suitable for subsequence targeted integration.

In certain embodiments, the present disclosure provides methods for preparing TI host cells suitable for subsequent targeted integration comprising: a) providing a TI host cell comprising an exogenous nucleotide sequence integrated at a site within an endogenous gene selected from the group consisting of LOC107977062, LOC100768845, ITPR2, ERE67000.1, UBAP2, MTMR2, XP_003512331.2, and sequences at least about 90% homologous thereto, wherein the exogenous nucleotide sequence comprises a first and a second RRS flanking at least one exogenous SOI and at least one first selection marker; b) introducing into the cell provided in a) a vector comprising three RRSs, wherein the first RRS of the vector matches the first RRS on the integrated exogenous nucleotide sequence, the second RRS of the vector matches the second RRS on the integrated exogenous nucleotide sequence, and at least one second selection marker located between the first and the second RRS; c) introducing a recombinase, wherein the recombinase recognizes the first and the second RRS on both the vector and the integrated exogenous nucleotide sequence; and d) selecting for TI host cells expressing the second selection marker to thereby isolate a TI host cell suitable for subsequent targeted integration.

6.2 Methods for Targeted Modification of a Host Cell Using Homologous Recombination, HDR, or NHEJ In certain embodiments, the present disclosure provides methods for preparing TI host cells to express a polypeptide of interest comprising: a) providing a TI host cell comprising a locus of the genome of the host cell, wherein the locus is at least about 90% homologous to SEQ ID Nos. 1-7; b) introducing a vector into the TI host cell, wherein the vector comprises nucleotide sequences at least 50% homologous to a sequence selected from SEQ ID No. 1-7 flanking a DNA cassette, wherein the DNA cassette comprises at least one selection marker and at least one exogenous SOI; c) selecting for the selection marker to isolate a TI host cell with the SOI integrated in the locus of the genome, and expressing the polypeptide of interest. In certain embodiments, the DNA cassette of the vector further comprises at least one selection marker and at least one exogenous SOI flanked by two RRSs.

In certain embodiments, the present disclosure provides methods for preparing TI host cells to express a polypeptide of interest comprising g: a) providing a TI host cell comprising a locus of the genome of the host cell, wherein the locus is at least about 90% homologous to a sequence selected from SEQ ID Nos. 1-7; b) introducing a polynucleotide into the host cell, wherein the polynucleotide comprises nucleotide sequences at least 50% homologous to a sequence selected from SEQ ID No. 1-7 flanking a DNA cassette, wherein the DNA cassette comprises at least one selection marker and at least one exogenous SOI; c) selecting for the selection marker to isolate a TI host cell with the SOI integrated in the locus of the genome, and expressing the polypeptide of interest. In certain embodiments, the DNA cassette of the vector further comprises at least one selection marker and at least one exogenous SOI flanked by two RRSs.

In certain embodiments, the homologous recombination is facilitated by an integrating vector. In certain embodiments, a vector is selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid. In certain embodiments, the transposon can be a PiggyBac (PB) transposon system.

In certain embodiments, the integration is promoted by an exogenous nuclease. In certain embodiments, the exogenous nuclease is selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

In certain embodiments, the present disclosure provides methods for preparing TI host cells suitable for subsequent targeted integration comprising: a) providing a TI host cell comprising a locus of the genome of the host cell, wherein the locus is at least about 90% homologous to a sequence selected from SEQ ID Nos. 1-7; b) introducing a vector into the TI host cell, wherein the vector comprises nucleotide sequences at least 50% homologous to a sequences selected from SEQ ID Nos. 1-7 flanking a DNA cassette, wherein the DNA cassette comprises at least one selection marker flanked by two RRSs; c) selecting for the selection marker to isolate a TI host cell suitable for subsequent targeted integration.

In certain embodiments, the present disclosure provides methods for preparing TI host cells suitable for subsequent targeted integration comprising: a) providing a TI host cell comprising a locus of the genome of the host cell, wherein the locus is at least about 90% homologous to a sequence selected from SEQ ID Nos. 1-7; b) introducing a polynucleotide into the TI host cell, wherein the polynucleotide comprises nucleotide sequences at least 50% homologous to a sequence selected from SEQ ID Nos. 1-7 flanking a DNA cassette, wherein the DNA cassette comprises at least one selection marker flanked by two RRSs; c) selecting for the selection marker to isolate a TI host cell suitable for subsequent targeted integration.

In certain embodiments, the present disclosure provides methods for preparing TI host cells suitable for subsequent targeted integration comprising: a) providing a TI host cell comprising a locus of the genome of the host cell, wherein the locus is at least about 90% homologous to a sequence selected from SEQ ID Nos. 1-7; b) introducing a vector into the host cell, wherein the vector comprises nucleotide sequences at least 50% homologous to a sequence selected from SEQ ID Nos. 1-7 flanking a DNA cassette, wherein the DNA cassette comprises three RRSs, wherein the third RRS and at least one selection marker is located between the first and the second RRS; and c) selecting for the selection marker to isolate a TI host cell suitable for subsequent targeted integration.

In certain embodiments, the present disclosure provides methods for preparing TI host cells suitable for subsequent targeted integration comprising: a) providing a TI host cell comprising a locus of the genome of the host cell, wherein the locus is at least about 90% homologous to a sequence selected from SEQ ID Nos. 1-7; b) introducing a polynucleotide into the host cell, wherein the polynucleotide comprises nucleotide sequences at least 50% homologous to a sequence selected from SEQ ID Nos. 1-7 flanking a DNA cassette, wherein the DNA cassette comprises three RRSs, wherein the third RRS and at least one selection marker is located between the first and the second RRS; and c) selecting for the selection marker to isolate a TI host cell suitable for subsequent targeted integration.

In certain embodiments, the present disclosure provides methods for preparing a TI host cell expressing at least one polypeptide of interest comprising: a) providing a TI host cell comprising at least one exogenous nucleotide sequence integrated at a site within one or more loci of the genome of the TI host cell, wherein the one or more loci are at least about 90% homologous to a sequence selected from SEQ ID Nos. 1-7, wherein the at least one exogenous nucleotide sequence comprises two RRSs, flanking at least one first selection marker; b) introducing into the cell provided in a) a vector comprising two RRSs matching the two RRSs on the integrated exogenous nucleotide sequence and flanking at least one exogenous SOI and at least one second selection marker; c) introducing a recombinase or a nucleic acid encoding a recombinase, wherein the recombinase recognizes the RRSs; and selecting for TI cells expressing the second selection marker to thereby isolate a TI host cell expressing the at least one polypeptide of interest.

In certain embodiments, the present disclosure provides methods for preparing a TI host cell expressing at least one first and second polypeptide of interest (where the first and second polypeptides can be the same or different) comprising: a) providing a TI host cell comprising at least one exogenous nucleotide sequence integrated at a site within one or more loci of the genome of the host cell, wherein one or more loci are at least about 90% homologous to a sequence selected from SEQ ID Nos. 1-7, wherein the exogenous nucleotide sequence comprises a first and a second RRS flanking at least one first selection marker, and a third RRS located between the first and the second RRS, and all the RRSs are heterospecific; b) introducing into the cell provided in a) a first vector comprising two RRSs matching the first and the third RRS on the at least one integrated exogenous nucleotide sequence and flanking at least one first exogenous SOI and at least one second selection marker; c) introducing into the cell provided in a) a second vector comprising two RRSs matching the second and the third RRS on the at least one integrated exogenous nucleotide sequence and flanking at least one second exogenous SOI; d) introducing one or more recombinases, or one or more nucleic acids encoding one or more recombinases, wherein the one or more recombinases recognize the RRSs; and e) selecting for TI cells expressing the second selection marker to thereby isolate a TI host cell expressing the at least one first and second polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

In certain embodiments, the present disclosure provides methods for preparing a TI host cell expressing a polypeptide of interest comprising: a) providing a TI host cell comprising at least one exogenous nucleotide sequence integrated at a site within one or more loci of the genome of the TI host cell, wherein the one or more loci are at least about 90% homologous to a sequence selected from SEQ ID Nos. 1-7, wherein the exogenous nucleotide sequence comprises one or more RRSs; b) introducing into the cell provided in a) a vector comprising one or more RRSs matching the one or more RRSs on the integrated exogenous nucleotide sequence and flanking at least one exogenous SOI operably linked to a regulatable promoter; c) introducing a recombinase or a nucleic acid encoding a recombinase, wherein the recombinase recognizes the RRSs; and d) selecting for TI cells expressing the exogenous SOI in the presence of an inducer to thereby isolate a TI host cell expressing the polypeptide of interest.

In certain embodiments, the present disclosure provides methods for expressing a polypeptide of interest comprising: a) providing a host cell comprising at least one exogenous SOI flanked by two RRSs and a regulatable promoter integrated within a locus of the genome of the host cell, wherein the locus is at least about 90% homologous to a sequence selected from SEQ ID Nos. 1-7; and b) culturing the cell under conditions suitable for expressing the SOI and recovering a polypeptide of interest therefrom.

In certain embodiments, the present disclosure provides methods for preparing a TI host cell expressing a first and second polypeptide of interest (where the first and second polypeptides can be the same or different) comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first, second RRS and a third RRS located between the first and the second RRS, and all the RRSs are heterospecific; b) introducing into the cell provided in a) a first vector comprising two RRSs matching the first and the third RRS on the integrated exogenous nucleotide sequence and flanking at least one first exogenous SOI operably linked to a regulatable promoter; c) introducing into the cell provided in a) a second vector comprising two RRSs matching the second and the third RRS on the integrated exogenous nucleotide sequence and flanking at least one second exogenous SOI operably linked to a regulatable promoter; d) introducing one or more recombinases, or one or more nucleic acids encoding one or more recombinases, wherein the one or more recombinases recognize the RRSs; and e) selecting for TI cells expressing the at least first and second exogenous SOIs in the presence of an inducer to thereby isolate a TI host cell expressing the polypeptides of interest. In certain embodiments, rather than have the entire selection maker on the first vector, the first vector comprises a promoter sequence operably linked to the codon ATG positioned flanked upstream by the first SOI and downstream by an RRS; and the second vector comprises a selection marker lacking an ATG transcription start codon flanked upstream by an RRS and downstream by the second SOI.

7. Products

The host cells of the present disclosure can be used for the expression of any molecule of interest, e.g., a polypeptide of interest. In certain embodiments, the host cells of the present disclosure can be used for the expression of polypeptides, e.g., mammalian polypeptides. Non-limiting examples of such polypeptides include hormones, receptors, fusion proteins, regulatory factors, growth factors, complement system factors, enzymes, clotting factors, anti-clotting factors, kinases, cytokines, CD proteins, interleukins, therapeutic proteins, diagnostic proteins and antibodies. In some embodiments, the antibody is a monoclonal antibody. In some embodiments, the antibody is a therapeutic antibody. In some embodiments, the antibody is a diagnostic antibody. In some embodiments, the antibody is a human antibody. In some embodiments, the antibody is a humanized antibody.

In certain embodiments, examples of polypeptides encompassed within the definition herein include mammalian polypeptides, such as, e.g., renin; a growth hormone, including human growth hormone and bovine growth hormone; growth hormone releasing factor; parathyroid hormone; thyroid stimulating hormone; lipoproteins; alpha-1-antitrypsin; insulin A-chain; insulin B-chain; proinsulin; follicle stimulating hormone; calcitonin; luteinizing hormone; glucagon; leptin; clotting factors such as factor VIIIC, factor IX, tissue factor, and von Willebrands factor; anti-clotting factors such as Protein C; atrial natriuretic factor; lung surfactant; a plasminogen activator, such as urokinase or human urine or tissue-type plasminogen activator (t-PA); bombesin; thrombin; hematopoietic growth factor; tumor necrosis factor-alpha and -beta; a tumor necrosis factor receptor such as death receptor κ and CD120; TNF-related apoptosis-inducing ligand (TRAIL); B-cell maturation antigen (BCMA); B-lymphocyte stimulator (BLyS); a proliferation-inducing ligand (APRIL); enkephalinase; RANTES (regulated on activation normally T-cell expressed and secreted); human macrophage inflammatory protein (MIP-1-alpha); a serum albumin such as human serum albumin; Muellerian-inhibiting substance; relaxin A-chain; relaxin B-chain; prorelaxin; mouse gonadotropin-associated peptide; a microbial protein, such as beta-lactamase; DNase; IgE; a cytotoxic T-lymphocyte associated antigen (CTLA), such as CTLA-4; inhibin; activin; platelet-derived endothelial cell growth factor (PD-ECGF); a vascular endothelial growth factor family protein (e.g., VEGF-A, VEGF-B, VEGF-C, VEGF-D, and P1GF); a platelet-derived growth factor (PDGF) family protein (e.g., PDGF-A, PDGF-B, PDGF-C, PDGF-D, and dimers thereof); fibroblast growth factor (FGF) family such as aFGF, bFGF, FGF4, and FGF9; epidermal growth factor (EGF); receptors for hormones or growth factors such as a VEGF receptor(s) (e.g., VEGFR1, VEGFR2, and VEGFR3), epidermal growth factor (EGF) receptor(s) (e.g., ErbB1, ErbB2, ErbB3, and ErbB4 receptor), platelet-derived growth factor (PDGF) receptor(s) (e.g., PDGFR-α and PDGFR-β), and fibroblast growth factor receptor(s); TIE ligands (Angiopoietins, ANGPT1, ANGPT2); Angiopoietin receptor such as TIE1 and TIE2; protein A or D; rheumatoid factors; a neurotrophic factor such as bone-derived neurotrophic factor (BDNF), neurotrophin-3, -4, -5, or -6 (NT-3, NT-4, NT-5, or NT-6), or a nerve growth factor such as NGF-b; transforming growth factor (TGF) such as TGF-alpha and TGF-beta, including TGF-β1, TGF-β2, TGF-β3, TGF-β4, or TGF-β5; insulin-like growth factor-I and -II (IGF-I and IGF-II); des(1-3)-IGF-I (brain IGF-I), insulin-like growth factor binding proteins (IGFBPs); CD proteins such as CD3, CD4, CD8, CD19 and CD20; erythropoietin; osteoinductive factors; immunotoxins; a bone morphogenetic protein (BMP); a chemokine such as CXCL12 and CXCR4; an interferon such as interferon-alpha, -beta, and -gamma; colony stimulating factors (CSFs), e.g., M-CSF, GM-CSF, and G-CSF; a cytokine such as interleukins (ILs), e.g., IL-1 to IL-10; midkine; superoxide dismutase; T-cell receptors; surface membrane proteins; decay accelerating factor; viral antigen such as, for example, a portion of the AIDS envelope; transport proteins; homing receptors; addressins; regulatory proteins; integrins such as CD11a, CD11b, CD11c, CD18, an ICAM, VLA-4 and VCAM; ephrins; Bv8; Delta-like ligand 4 (DLL4); Del-1; BMP9; BMP10; Follistatin; Hepatocyte growth factor (HGF)/scatter factor (SF); Alkl; Robo4; ESM1; Perlecan; EGF-like domain, multiple 7 (EGFL7); CTGF and members of its family; thrombospondins such as thrombospondin1 and thrombospondin2; collagens such as collagen IV and collagen XVIII; neuropilins such as NRP1 and NRP2; Pleiotrophin (PTN); Progranulin; Proliferin; Notch proteins such as Notch1 and Notch4; semaphorins such as Sema3A, Sema3C, and Sema3F; a tumor associated antigen such as CA125 (ovarian cancer antigen); immunoadhesins; and fragments and/or variants of any of the above-listed polypeptides as well as antibodies, including antibody fragments, binding to one or more protein, including, for example, any of the above-listed proteins.

In certain embodiments, the polypeptide of interest is a bi-specific, tri-specific or multi-specific polypeptide, e.g. a bi-specific antibody. Various molecular formats for multispecific antibodies are known in the art and are included herein (see e.g., Spiess et al., Mol Immunol 67 (2015) 95-106). A particular type of multispecific antibodies, also included herein, are bispecific antibodies designed to simultaneously bind to a surface antigen on a target cell, e.g., a tumor cell, and to an activating, invariant component of the T cell receptor (TCR) complex, such as CD3, for retargeting of T cells to kill target cells. Other examples of bispecific antibody formats include, but are not limited to, the so-called "BiTE" (bispecific T cell engager) molecules wherein two scFv molecules are fused by a flexible linker (see, e.g., WO 2004/106381, WO 2005/061547, WO 2007/042261, and WO 2008/119567, Nagorsen and Bauerle, Exp Cell Res 317, 1255-1260 (2011)); diabodies (Holliger et al., Prot Eng 9, 299-305 (1996)) and derivatives thereof, such as tandem diabodies ("TandAb"; Kipriyanov et al., J Mol Biol 293, 41-56 (1999)); "DART" (dual affinity retargeting) molecules which are based on the diabody format but feature a C-terminal disulfide bridge for additional stabilization (Johnson et al., J Mol Biol 399, 436-449 (2010)), and so-called triomabs, which are whole hybrid mouse/rat IgG molecules (reviewed in Seimetz et al., Cancer Treat Rev 36, 458-467 (2010)). Particular T cell bispecific antibody formats included herein are described in WO 2013/026833, WO 2013/026839, WO 2016/020309; Bacac et al., Oncoimmunology 5(8) (2016) e1203498.

In certain embodiments, the host cells of the present disclosure can be used for the expression of chaperones, protein modifying enzymes, shRNA, gRNA or other proteins or peptides while expressing a therapeutic protein or molecule of interest constitutively or regulated.

In some embodiments, the polypeptide expressed by the host cells of the present disclosure may bind to, or interact with, any protein, including, without limitation, cytokines, cytokine-related proteins, and cytokine receptors selected from the group consisting of 8MPI, 8MP2, 8MP38 (GD-FIO), 8MP4, 8MP6, 8MP8, CSFI (M-CSF), CSF2 (GM-CSF), CSF3 (G-CSF), EPO, FGF1 (αFGF), FGF2 (βFGF), FGF3 (int-2), FGF4 (HST), FGF5, FGF6 (HST-2), FGF7 (KGF), FGF9, FGF1 0, FGF11, FGF12, FGF12B, FGF14, FGF16, FGF17, FGF19, FGF20, FGF21, FGF23, IGF1, IGF2, IFNA1, IFNA2, IFNA4, IFNA5, IFNA6, IFNA7, IFN81, IFNG, IFNWI, FEL1, FEL1 (EPSELON), FEL1 (ZETA), IL 1A, IL 1n, IL2, IL3, IL4, IL5, IL6, IL7, IL8, IL9, IL1 0, IL 11, IL 12A, IL 12B, IL 13, IL 14, IL 15, IL 16, IL 17, IL 17B, IL 18, IL 19, IL20, IL22, IL23, IL24, IL25, IL26, IL27, IL28A, IL28B, IL29, IL30, PDGFA, PDGFB, TGFA, TGFB1, TGFB2, TGFBb3, LTA (TNF-β), LTB, TNF (TNF-α), TNFSF4 (OX40 ligand), TNFSF5 (CD40 ligand), TNFSF6 (FasL), TNFSF7 (CD27 ligand), TNFSF8 (CD30 ligand), TNFSF9 (4-1 BB ligand), TNFSF10 (TRAIL), TNFSF11 (TRANCE), TNFSF12 (APO3L), TNFSF13 (April), TNFSF13B, TNFSF14 (HVEM-L), TNFSF15 (VEGI), TNFSF18, HGF (VEGFD), VEGF, VEGFB, VEGFC, IL1R1, IL1R2, IL1RL1, IL1RL2, IL2RA, IL2RB, IL2RG, IL3RA, IL4R, IL5RA, IL6R, IL7R, IL8RA, IL8RB, IL9R, ILORA, IL10RB, IL 11RA, IL12RB1, IL12RB2, IL13RA1, IL13RA2, IL15RA, IL17R, IL18R1, IL20RA, IL21R, IL22R, IL1HY1, IL1RAP, IL1RAPL1, IL1RAPL2, IL1RN, IL6ST, IL18BP, IL8RAP, IL22RA2, AIF1, HGF, LEP (leptin), PTN, and THPO.k.

In some embodiments, the polypeptide expressed by the host cells of the present disclosure may bind to, or interact with, a chemokine, chemokine receptor, or a chemokine-related protein selected from the group consisting of CCLI (1-309), CCL2 (MCP-1/MCAF), CCL3 (MIP-Iα), CCL4 (MIP-Iβ), CCL5 (RANTES), CCL7 (MCP-3), CCL8 (mcp-2), CCL11 (eotaxin), CCL 13 (MCP-4), CCL 15 (MIP-Iδ), CCL 16 (HCC-4), CCL 17 (TARC), CCL 18 (PARC), CCL 19 (MDP-3b), CCL20 (MIP-3α), CCL21 (SLC/exodus-2), CCL22 (MDC/STC-1), CCL23 (MPIF-1), CCL24 (MPIF-2/eotaxin-2), CCL25 (TECK), CCL26 (eotaxin-3), CCL27 (CTACK/ILC), CCL28, CXCLI (GROI), CXCL2 (GR02), CXCL3 (GR03), CXCL5 (ENA-78), CXCL6 (GCP-2), CXCL9 (MIG), CXCL 10 (IP 10), CXCL 11 (1-TAC), CXCL 12 (SDFI), CXCL 13, CXCL 14, CXCL 16, PF4 (CXCL4), PPBP (CXCL7), CX3CL 1 (SCYDI), SCYEI, XCLI (lymphotactin), XCL2 (SCM-Iβ), BLRI (MDR15), CCBP2 (D6/JAB61), CCRI (CKRI/HM145), CCR2 (mcp-IRB IRA), CCR3 (CKR3/CMKBR3), CCR4, CCR5 (CMKBR5/ChemR13), CCR6 (CMKBR6/CKR-L3/STRL22/DRY6), CCR7 (CKR7/EBII), CCR8 (CMKBR8/TER1/CKR-L1), CCR9 (GPR-9-6), CCRL1 (VSHK1), CCRL2 (L-CCR), XCR1 (GPR5/CCXCR1), CMKLR1, CMKOR1 (RDC1), CX3CR1 (V28), CXCR4, GPR2 (CCR10), GPR31, GPR81 (FKSG80), CXCR3 (GPR9/CKR-L2), CXCR6 (TYMSTR/STRL33/Bonzo), HM74, IL8RA (IL8Rα), IL8RB (IL8Rβ), LTB4R (GPR16), TCP10, CKLFSF2, CKLFSF3, CKLFSF4, CKLFSF5, CKLFSF6, CKLFSF7, CKLFSF8, BDNF, C5, C5R1, CSF3, GRCC10 (C10), EPO, FY (DARC), GDF5, HDF1, HDF1α, DL8, PRL, RGS3, RGS13, SDF2, SLIT2, TLR2, TLR4, TREM1, TREM2, and VHL. In some embodiments, the polypeptide expressed by the host cells of the present disclosure may bind to, or interact with, 0772P (CA125, MUC16) (i.e., ovarian cancer antigen), ABCF1; ACVR1; ACVR1B; ACVR2; ACVR2B; ACVRL1; ADORA2A; Aggrecan; AGR2; AICDA; AIF1; AIG1; AKAP1; AKAP2; AMH; AMHR2; amyloid beta; ANGPTL; ANGPT2; ANGPTL3; ANGPTL4; ANPEP; APC; APOC1; AR; ASLG659; ASPHD1 (aspartate beta-hydroxylase domain containing 1; LOC253982); AZGP1 (zinc-a-glycoprotein); B7.1; B7.2; BAD; BAFF-R (B cell-activating factor receptor, BLyS receptor 3, BR3; BAG1; BAIl; BCL2; BCL6; BDNF; BLNK; BLRI (MDR15); BMP1; BMP2; BMP3B (GDF10); BMP4; BMP6; BMP8; BMPR1A; BMPR1B (bone morphogenic protein receptor-type IB); BMPR2; BPAG1 (plectin); BRCA1; Brevican; C19orf10 (IL27w); C3; C4A; C5; C5R1; CANT1; CASP1; CASP4; CAV1; CCBP2 (D6/JAB61); CCL1 (1-309); CCL11 (eotaxin); CCL13 (MCP-4); CCL15 (MIP16); CCL16 (HCC-4); CCL17 (TARC); CCL18

(PARC); CCL19 (MIP-3β); CCL2 (MCP-1); MCAF; CCL20 (MIP-3α); CCL21 (MTP-2); SLC; exodus-2; CCL22 (MDC/STC-1); CCL23 (MPIF-1); CCL24 (MPIF-2/eotaxin-2); CCL25 (TECK); CCL26 (eotaxin-3); CCL27 (CTACK/ILC); CCL28; CCL3 (MTP-Iα); CCL4 (MDP-Iβ); CCL5(RANTES); CCL7 (MCP-3); CCL8 (mcp-2); CCNA1; CCNA2; CCND1; CCNE1; CCNE2; CCR1 (CKRI/HM145); CCR2 (mcp-IRβ/RA); CCR3 (CKR/CMKBR3); CCR4; CCR5 (CMKBR5/ChemR13); CCR6 (CMKBR6/CKR-L3/STRL22/DRY6); CCR7 (CKBR7/EBI1); CCR8 (CMKBR8/TER1/CKR-L1); CCR9 (GPR-9-6); CCRL1 (VSHK1); CCRL2 (L-CCR); CD164; CD19; CD1C; CD20; CD200; CD22 (B-cell receptor CD22-B isoform); CD24; CD28; CD3; CD37; CD38; CD3E; CD3G; CD3Z; CD4; CD40; CD40L; CD44; CD45RB; CD52; CD69; CD72; CD74; CD79A (CD79a, immunoglobulin-associated alpha, a B cell-specific protein); CD79B; CDS; CD80; CD81; CD83; CD86; CDH1 (E-cadherin); CDH10; CDH12; CDH13; CDH18; CDH19; CDH20; CDH5; CDH7; CDH8; CDH9; CDK2; CDK3; CDK4; CDK5; CDK6; CDK7; CDK9; CDKN1A (p21/WAF1/Cip1); CDKN1B (p27/Kipl); CDKN1C; CDKN2A (P16NK4a); CDKN2B; CDKN2C; CDKN3; CEBPB; CER1; CHGA; CHGB; Chitinase; CHST10; CKLFSF2; CKLFSF3; CKLFSF4; CKLFSF5; CKLFSF6; CKLFSF7; CKLFSF8; CLDN3; CLDN7 (claudin-7); CLL-1 (CLEC12A, MICL, and DCAL2); CLN3; CLU (clusterin); CMKLR1; CMKOR1 (RDC1); CNR1; COL 18A1; COL1A1; COL4A3; COL6A1; complement factor D; CR2; CRP; CRIPTO (CR, CR1, CRGF, CRIPTO, TDGF1, teratocarcinoma-derived growth factor); CSFI (M-CSF); CSF2 (GM-CSF); CSF3 (GCSF); CTLA4; CTNNB1 (b-catenin); CTSB (cathepsin B); CX3CL1 (SCYDI); CX3CR1 (V28); CXCL1 (GRO1); CXCL10 (IP-10); CXCL11 (I-TAC/IP-9); CXCL12 (SDF1); CXCL13; CXCL14; CXCL16; CXCL2 (GRO2); CXCL3 (GRO3); CXCL5 (ENA-78/LIX); CXCL6 (GCP-2); CXCL9 (MIG); CXCR3 (GPR9/CKR-L2); CXCR4; CXCR5 (Burkitt's lymphoma receptor 1, a G protein-coupled receptor); CXCR6 (TYMSTR/STRL33/Bonzo); CYBS; CYC1; CYSLTR1; DAB2IP; DES; DKFZp451J0118; DNCLI; DPP4; E16 (LAT1, SLC7A5); E2F1; ECGF1; EDG1; EFNA1; EFNA3; EFNB2; EGF; EGFR; ELAC2; ENG; ENO1; ENO2; ENO3; EPHB4; EphB2R; EPO; ERBB2 (Her-2); EREG; ERK8; ESR1; ESR2; ETBR (Endothelin type B receptor); F3 (TF); FADD; FasL; FASN; FCER1A; FCER2; FCGR3A; FcRH1 (Fc receptor-like protein 1); FcRH2 (IFGP4, IRTA4, SPAP1A (SH2 domain containing phosphatase anchor protein 1a), SPAPIB, SPAPIC); FGF; FGF1 (αFGF); FGF10; FGF11; FGF12; FGF12B; FGF13; FGF14; FGF16; FGF17; FGF18; FGF19; FGF2 (bFGF); FGF20; FGF21; FGF22; FGF23; FGF3 (int-2); FGF4 (HST); FGF5; FGF6 (HST-2); FGF7 (KGF); FGF8; FGF9; FGFR; FGFR3; FIGF (VEGFD); FEL (EPSILON); FIL1 (ZETA); FLJ12584; FLJ25530; FLRTI (fibronectin); FLT1; FOS; FOSL1 (FRA-1); FY (DARC); GABRP (GABAa); GAGEB1; GAGEC1; GALNAC4S-6ST; GATA3; GDF5; GDNF-Ral (GDNF family receptor alpha 1; GFRA1; GDNFR; GDNFRA; RETL1; TRNR1; RETIL; GDNFR-alpha1; GFR-ALPHA-1); GEDA; GFI1; GGT1; GM-CSF; GNASI; GNRHI; GPR2 (CCR10); GPR19 (G protein-coupled receptor 19; Mm.4787); GPR31; GPR44; GPR54 (KISS1 receptor; KISSIR; GPR54; HOT7T175; AXOR12); GPR81 (FKSG80); GPR172A (G protein-coupled receptor 172A; GPCR41; FLJ11856; D15Ertd747e); GRCCIO (C10); GRP; GSN (Gelsolin); GSTP1; HAVCR2; HDAC4; HDAC7A; HDAC9; HGF; HIF1A; HOPi; histamine and histamine receptors; HLA-A; HLA-DOB (Beta subunit of MHC class II molecule (Ia antigen); HLA-DRA; HM74; HMOXI; HUMCYT2A; ICEBERG; ICOSL; 1D2; IFN-a; IFNA1; IFNA2; IFNA4; IFNA5; IFNA6; IFNA7; IFNB1; IFNgamma; DFNW1; IGBP1; IGF1; IGF1R; IGF2; IGFBP2; IGFBP3; IGFBP6; IL-1; IL10; IL10RA; IL10RB; IL11; IL11RA; IL-12; IL12A; IL12B; IL12RB1; IL12RB2; IL13; IL13RA1; IL13RA2; IL14; IL15; IL15RA; IL16; IL17; IL17B; IL17C; L17R; IL18; IL18BP; IL18R1; IL18RAP; IL19; IL1A; IL1B; ILIF10; IL1F5; IL1F6; IL1F7; IL1F8; IL1F9; IL1HY1; IL1R1; IL1R2; IL1RAP; IL1RAPL1; IL1RAPL2; IL1RL1; IL1RL2, ILIRN; IL2; IL20; IL20Rα; IL21R; IL22; IL-22c; IL22R; IL22RA2; IL23; IL24; IL25; IL26; IL27; IL28A; IL28B; IL29; IL2RA; IL2RB; IL2RG; IL3; IL30; IL3RA; IL4; IL4R; ILS; IL5RA; IL6; IL6R; IL6ST (glycoprotein 130); influenza A; influenza B; EL7; EL7R; EL8; IL8RA; DL8RB; IL8RB; DL9; DL9R; DLK; INHA; INHBA; INSL3; INSL4; IRAK1; IRTA2 (Immunoglobulin superfamily receptor translocation associated 2); ERAK2; ITGA1; ITGA2; ITGA3; ITGA6 (a6 integrin); ITGAV; ITGB3; ITGB4 (b4 integrin); α4β7 and αEβ7 integrin heterodimers; JAG1; JAK1; JAK3; JUN; K6HF; KAll; KDR; KITLG; KLF5 (GC Box BP); KLF6; KLKIO; KLK12; KLK13; KLK14; KLK15; KLK3; KLK4; KLK5; KLK6; KLK9; KRT1; KRT19 (Keratin 19); KRT2A; KHTHB6 (hair-specific type H keratin); LAMAS; LEP (leptin); LGR5 (leucine-rich repeat-containing G protein-coupled receptor 5; GPR49, GPR67); Lingo-p75; Lingo-Troy; LPS; LTA (TNF-b); LTB; LTB4R (GPR16); LTB4R2; LTBR; LY64 (Lymphocyte antigen 64 (RP105), type I membrane protein of the leucine rich repeat (LRR) family); Ly6E (lymphocyte antigen 6 complex, locus E; Ly67,RIG-E,SCA-2,TSA-1); Ly6G6D (lymphocyte antigen 6 complex, locus G6D; Ly6-D, MEGT1); LY6K (lymphocyte antigen 6 complex, locus K; LY6K; HSJ001348; FLJ35226); MAC-MARCKS; MAG or OMgp; MAP2K7 (c-Jun); MDK; MDP; MIB1; midkine; MEF; MIP-2; MKI67; (Ki-67); MMP2; MMP9; MPF (MPF, MSLN, SMR, megakaryocyte potentiating factor, mesothelin); MS4A1; MSG783 (RNF124, hypothetical protein FLJ20315); MSMB; MT3 (metallothionectin-111); MTSS1; MUC1 (mucin); MYC; MY088; Napi3b (also known as NaPi2b) (NAPI-3B, NPTIIb, SLC34A2, solute carrier family 34 (sodium phosphate), member 2, type II sodium-dependent phosphate transporter 3b); NCA; NCK2; neurocan; NFKB1; NFKB2; NGFB (NGF); NGFR; NgR-Lingo; NgR-Nogo66 (Nogo); NgR-p75; NgR-Troy; NME1 (NM23A); NOX5; NPPB; NROB1; NROB2; NR1D1; NR1D2; NR1H2; NR1H3; NR1H4; NR112; NR113; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRP1; NRP2; NT5E; NTN4; ODZI; OPRD1; OX40; P2RX7; P2X5 (Purinergic receptor P2X ligand-gated ion channel 5); PAP; PARTi; PATE; PAWR; PCA3; PCNA; PD-Li; PD-L2; PD-1; POGFA; POGFB; PECAMI; PF4 (CXCL4); PGF; PGR; phosphacan; PIAS2; PIK3CG; PLAU (uPA); PLG; PLXDCI; PMEL17 (silver homolog; SILV; D12S53E; PMEL17; SI; SIL); PPBP (CXCL7); PPID; PRI; PRKCQ; PRKDI; PRL; PROC; PROK2; PSAP; PSCA hlg (2700050C12Rik, C530008016Rik, RIKEN cDNA 2700050C12, RIKEN cDNA 2700050C12 gene); PTAFR; PTEN; PTGS2 (COX-2); PTN; RAC2 (p21 Rac2); RARB; RET (ret proto-oncogene; MEN2A; HSCR1; MEN2B; MTC1; PTC; CDHF12; Hs.168114; RET51; RET-ELE1); RGSI; RGS13; RGS3; RNF110 (ZNF144); ROBO2; S100A2; SCGB1D2 (lipophilin B); SCGB2A1 (mammaglobin2); SCGB2A2 (mammaglobin 1); SCYEI (endothelial Monocyte-activating cytokine); SDF2; Sema 5b (FLJ10372, KIAA1445, Mm.42015, SEMA5B, SEMAG, Semaphorin 5b Hlog, sema domain, seven thrombospondin repeats (type 1 and type 1-like), transmembrane domain (TM) and short cytoplasmic domain, (semaphorin) 5B); SERPINAI; SERPINA3; SERPINBS (maspin); SERPINEI(PAI-1); SERPDMFI; SHBG; SLA2; SLC2A2; SLC33A1; SLC43A1; SLIT2; SPPI; SPRRIB (Sprl); ST6GAL1; STABI; STAT6; STEAP (six transmembrane epithelial antigen of prostate); STEAP2 (HGNC_8639, IPCA-1, PCANAP1, STAMP1, STEAP2, STMP, prostate cancer associated gene 1, prostate cancer associated protein 1, six transmembrane epithelial antigen of prostate 2, six transmembrane prostate protein); TB4R2; TBX21; TCPIO; TOGFI; TEK; TENB2 (putative transmembrane proteoglycan); TGFA; TGFBI; TGFB1II; TGFB2; TGFB3; TGFBI; TGFBRI; TGFBR2; TGFBR3; THIL; THBSI (thrombospondin-1); THBS2; THBS4; THPO; TIE (Tie-1); TMP3; tissue factor; TLR1; TLR2; TLR3; TLR4; TLRS; TLR6; TLR7; TLR8; TLR9; TLR10; TMEFF1 (transmembrane protein with EGF-like and two follistatin-like domains 1; Tomoregulin-1); TMEM46 (shisa homolog 2); TNF; TNF-a; TNFAEP2 (B94); TNFAIP3; TNFRSFIIA; TNFRSFIA; TNFRSFIB; TNFRSF21; TNFRSF; TNFRSF6 (Fas); TNFRSF7; TNFRSF8; TNFRSF9; TNFSF10 (TRAIL); TNFSF11 (TRANCE); TNFSF12 (APO3L); TNFSF13 (April); TNFSF13B; TNFSF14 (HVEM-L); TNFSF15 (VEGI); TNFSFI8; TNFSF4 (OX40 ligand); TNFSF5 (CD40 ligand); TNFSF6 (FasL); TNFSF7 (CD27 ligand); TNFSFS (CD30 ligand); TNFSF9 (4-1 BB ligand); TOLLIP; Toll-like receptors; TOP2A (topoisomerase Ea); TP53; TPM1; TPM2; TRADD; TMEM118 (ring finger protein, transmembrane 2; RNFT2; FLJ14627); TRAF1; TRAF2; TRAF3; TRAF4; TRAF5; TRAF6; TREM1; TREM2; TrpM4 (BR22450, FLJ20041, TRPM4, TRPM4B, transient receptor potential cation channel, subfamily M, member 4); TRPC6; TSLP; TWEAK; Tyrosinase (TYR; OCAIA; OCAlA; tyrosinase; SHEP3); VEGF; VEGFB; VEGFC; versican; VHL C5; VLA-4; XCL1 (lymphotactin); XCL2 (SCM-lb); XCRI(GPR5/CCXCRI); YY1; and/or ZFPM2.

In certain embodiments, target molecules for antibodies (or bispecific antibodies) produced according to the methods disclosed herein include CD proteins such as CD3, CD4, CDS, CD16, CD19, CD20, CD21 (CR2 (Complement receptor 2) or C3DR (C3d/Epstein Barr virus receptor) or Hs.73792); CD33; CD34; CD64; CD72 (B-cell differentiation antigen CD72, Lyb-2); CD79b (CD79B, CD790, IGb (immunoglobulin-associated beta), B29); CD200 members of the ErbB receptor family such as the EGF receptor, HER2, HER3, or HER4 receptor; cell adhesion molecules such as LFA-1, Mac1, p150.95, VLA-4, ICAM-1, VCAM, alpha4/beta7 integrin, and alphav/beta3 integrin including either alpha or beta subunits thereof (e.g., anti-CD11a, anti-CD18, or anti-CD11b antibodies); growth factors such as VEGF-A, VEGF-C; tissue factor (TF); alpha interferon (alphaIFN); TNFalpha, an interleukin, such as IL-1 beta, IL-3, IL-4, IL-5, IL-6, IL-8, IL-9, IL-13, IL 17 AF, IL-1S, IL-13R alpha1, IL13R alpha2, IL-4R, IL-5R, IL-9R, IgE; blood group antigens; flk2/flt3 receptor; obesity (OB) receptor; mpl receptor; CTLA-4; RANKL, RANK, RSV F protein, protein C etc. In certain embodiments, the methods provided herein can be used to produce an antibody (or a multispecific antibody, such as a bispecific antibody) that specifically binds to complement protein C5 (e.g., an anti-C5 agonist antibody that specifically binds to human C5).

In certain embodiments, the methods provided herein can be used to produce an antibody (or a multispecific antibody, such as a bispecific antibody) that specifically binds to influenza virus B hemagglutinin, i.e., "fluB" (e.g., an antibody that binds hemagglutinin from the Yamagata lineage of influenza B viruses, binds hemagglutinin from the Victoria lineage of influenza B viruses, binds hemagglutinin from ancestral lineages of influenza B virus, or binds hemagglutinin from the Yamagata lineage, the Victoria lineage, and ancestral lineages of influenza B virus, in vitro and/or in vivo). Further details regarding anti-FluB antibodies are described in WO 2015/148806, which is incorporated herein by reference in its entirety.

In certain embodiments, an antibody (or bispecific antibody) produced according to a method provided herein binds low density lipoprotein receptor-related protein (LRP)-1 or LRP-8 or transferrin receptor, and at least one target selected from the group consisting of beta-secretase (BACE1 or BACE2), alpha-secretase, gamma-secretase, tau-secretase, amyloid precursor protein (APP), death receptor 6 (DR6), amyloid beta peptide, alpha-synuclein, Parkin, Huntingtin, p75 NTR, CD40 and caspase-6.

In certain embodiments, the antibody produced according to a method provided herein is a human IgG2 antibody against CD40. In certain embodiments, the anti-CD40 antibody is RG7876.

In certain embodiments, the polypeptide produced according to a method provided herein is a targeted immunocytokine. In certain embodiments, the targeted immunocytokine is a CEA-IL2v immuocytokine. In certain embodiments, the CEA-IL2v immuocytokine is RG7813. In certain embodiments, the targeted immunocytokine is a FAP-IL2v immuocytokine. In certain embodiments, the FAP-IL2v immuocytokine is RG7461.

In certain embodiments, a multispecific antibody (such as a bispecific antibody) produced according to a method provided herein binds CEA and at least one additional target molecule. In certain embodiments, a multispecific antibody (such as a bispecific antibody) produced according to a method provided herein binds a tumor targeted cytokine and at least one additional target molecule. In certain embodiments, a multispecific antibody (such as a bispecific antibody) produced according to a method provided herein is fused to IL2v (i.e., an interleukin 2 variant) and binds an IL1-based immunocytokine and at least one additional target molecule. In certain embodiments, a multispecific antibody (such as a bispecific antibody) produced according to a method provided herein is a T-cell bispecific antibody (i.e., a bispecific T-cell engager or BiTE).

In certain embodiments, a multispecific antibody (such as a bispecific antibody) produced according to a method provided herein binds to at least two target molecules selected from: IL-1 alpha and IL-1 beta, IL-12 and IL-1S; IL-13 and IL-9; IL-13 and IL-4; IL-13 and IL-5; IL-5 and IL-4; IL-13 and IL-1beta; IL-13 and IL-25; IL-13 and TARC; IL-13 and MDC; IL-13 and MEF; IL-13 and TGF-~; IL-13 and LHR agonist; IL-12 and TWEAK, IL-13 and CL25; IL-13 and SPRR2a; IL-13 and SPRR2b; IL-13 and ADAMS, IL-13 and PED2, IL17A and IL17F, CEA and CD3, CD3 and CD19, CD138 and CD20; CD138 and CD40; CD19 and CD20; CD20 and CD3; CD3S and CD13S; CD3S and CD20; CD3S and CD40; CD40 and CD20; CD-S and IL-6; CD20 and BR3, TNF alpha and TGF-beta, TNF alpha and IL-1 beta; TNF alpha and IL-2, TNF alpha and IL-3, TNF alpha and IL-4, TNF alpha and IL-5, TNF alpha and IL6, TNF alpha and IL8, TNF alpha and IL-9, TNF alpha and IL-10, TNF alpha and IL-11, TNF alpha and IL-12, TNF alpha and IL-13, TNF alpha and IL-14, TNF alpha and IL-15, TNF alpha and IL-16, TNF alpha and IL-17, TNF alpha and IL-18, TNF alpha and IL-19, TNF alpha and IL-20, TNF alpha and IL-23, TNF alpha and IFN alpha, TNF alpha and CD4, TNF alpha and VEGF, TNF alpha and MIF, TNF alpha and ICAM-1, TNF alpha and PGE4, TNF alpha and PEG2, TNF alpha and RANK ligand, TNF alpha and Te38, TNF alpha and BAFF,TNF alpha and CD22, TNF alpha and CTLA-4, TNF alpha and GP130, TNF a and IL-12p40, VEGF and Angiopoietin, VEGF and HER2, VEGF-A and HER2, VEGF-A and PDGF, HER1 and HER2, VEGFA and ANG2,VEGF-A and VEGF-C, VEGF-C and VEGF-D, HER2 and DR5,VEGF and IL-8, VEGF and MET, VEGFR and MET receptor, EGFR and MET, VEGFR and EGFR, HER2 and CD64, HER2 and CD3, HER2 and CD16, HER2 and HER3; EGFR (HER1) and HER2, EGFR and HER3, EGFR and HER4, IL-14 and IL-13, IL-13 and CD40L, IL4 and CD40L, TNFR1 and IL-1R, TNFR1 and IL-6R and TNFR1 and IL-18R, EpCAM and CD3, MAPG and CD28, EGFR and CD64, CSPGs and RGM A; CTLA-4 and BTN02; IGF1 and IGF2; IGF1/2 and Erb2B; MAG and RGM A; NgR and RGM A; NogoA and RGM A; OMGp and RGM A; POL-1 and CTLA-4; and RGM A and RGM B.

In certain embodiments, the multispecific antibody (such as a bispecific antibody) is an anti-CEA/anti-CD3 bispecific antibody. In certain embodiments, the anti-CEA/anti-CD3 bispecific antibody is RG7802. Further details regarding anti-CEA/anti-CD3 bispecific antibodies are provided in WO 2014/121712, which is incorporated herein by reference in its entirety.

In certain embodiments, the multispecific antibody (such as a bispecific antibody) is an anti-VEGF/anti-angiopoietin bispecific antibody. In certain embodiments, the anti-VEGF/anti-angiopoietin bispecific antibody bispecific antibody is a Crossmab. In certain embodiments, the anti-VEGF/anti-angiopoietin bispecific antibody is RG7716.

In certain embodiments, the multispecific antibody (such as a bispecific antibody) is an anti-Ang2/anti-VEGF bispecific antibody. In certain embodiments, the anti-Ang2/anti-VEGF bispecific antibody is RG7221. In certain embodiments, the anti-Ang2/anti-VEGF bispecific antibody is CAS Number 1448221-05-3.

Many other antibodies and/or other proteins may be expressed by the host cells in accordance with the present disclosure, and the above lists are not meant to be limiting.

The host cells of the present disclosure may be employed in the production of a molecule of interest at manufacturing scale. "Manufacturing scale" production of therapeutic proteins, or other proteins, utilize cell cultures ranging from about 400 L to about 80,000 L, depending on the protein being produced and the need. Typically, such manufacturing scale production utilizes cell culture sizes from about 400 L to about 25,000 L. Within this range, specific cell culture sizes such as 4,000 L, about 6,000 L, about 8,000, about 10,000, about 12,000 L, about 14,000 L, or about 16,000 L may be utilized.

The host cells of the present disclosure can be employed in the production of large quantities of a molecule of interest in a shorter timeframe as compared to non-TI cells used in current cell culture methods. In certain embodiments, the host cells of the present disclosure can be employed for improved quality of the molecule of interest as compared to non-TI cells used in current cell culture methods. In certain embodiments, the host cells of the present disclosure can be used to enhance seed train stability by preventing chronic toxicity that can be caused by products that can cause cell stress and clonal instability over time. In certain embodiments, the host cells of the present disclosure can be used for the optimal expression of acutely toxic products.

In certain embodiments, the host cells, the TI systems of the present disclosure, can be used for cell culture process optimization and/or process development.

In certain embodiments, the host cells of the present disclosure can be used to accelerate the production of a molecule of interest by about 1 week, about, 2 weeks, about 3 weeks, about 4 weeks, about 5 weeks, about 6 weeks, about 7 weeks, about 8 weeks, about 9 weeks, or about 10 weeks as compared to non-TI cells used in conventional cell culture methods. In certain embodiments, the host cells of the present disclosure can be used to accelerate the harvest of a molecule of interest by about 1 week, about, 2 weeks, about 3 weeks, about 4 weeks, about 5 weeks, about 6 weeks, about 7 weeks, about 8 weeks, about 9 weeks, or about 10 weeks as compared to non-TI cells used in conventional cell culture methods.

In certain embodiments, the host cells of the present embodiment can be employed to reduce aggregate levels of a molecule of interest as compared to non-TI cells used in conventional cell culture methods.

In certain embodiments, the host cells of the present disclosure can be used to achieve increased expression of a polypeptide (or polypeptides) of interest relative to a randomly integrated host cell. For example, but not by way of limitation, the host cells of the present disclosure can achieve expression of standard and half antibodies at titers of at least 3 g/L, 3.5 g/L, 4 g/L, 4.5 g/L, 5 g/L, 5.5 g/L, 6 g/L, 6.5 g/L, 7 g/L, 7.5 g/L, 8 g/L, 8.5 g/L, 9 g/L, 9.5 g/L, 10 g/L, 10.5 g/L, 11 g/L, or more, and expression of multispecific antibodies, e.g., bispecific antibodies, of at least 1.5 g/L, 2 g/L, 2.5 g/L, 3 g/L, 3.5 g/L, 4 g/L, 4.5 g/L, 5 g/L, 5.5 g/L, 6 g/L, or more. In certain embodiments, the host cells of the present disclosure can achieve increased bispecific content relative to random integration host cells. For example, but not by way of limitation the host cells of the present disclosure can achieve bispecific content of at least 80%, 85%, 90%, 95%, 96%, 98%, 99% or more.

In certain embodiments, the host cells of the present disclosure can be used for the constitutive expression of selected subunits of a therapeutic molecule and the regulated expression of other, different subunits of the same therapeutic molecule. In certain embodiments the therapeutic molecule can be a fusion protein. In certain embodiments, the host cells of the present disclosure can be used to understand the roles and effects of each antibody subunit in the expression and secretion of fully assembled antibody molecules.

In certain embodiments, the host cells of the present disclosure can be used as an investigational tool. In certain embodiments, the host cells of the present disclosure can be used as a diagnostic tool to map out the root causes of low protein expression for problematic molecules in various cells. In certain embodiments, the host cells of the present disclosure can be used to directly link an observed phenomenon or cellular behavior to the transgene expression in the cells. The host cell of the present disclosure can also be used to demonstrate whether or not an observed behavior is reversible in the cells. In certain embodiments, the host cells of the present disclosure can be exploited to identify and mitigate problems with respect to transgene(s) transcription and expression in cells.

In certain embodiments, the host cells of the present disclosure can be used for swapping transgene subunits, such as but not limited to, HC and LC subunits of an antibody, of a difficult-to-express molecule with that of an average molecule in the TI system to identify the problematic subunit(s). In certain embodiments, amino acid sequence analysis can then be used to narrow down and focus on the amino acid residues or regions that might be responsible for low protein expression.

8. Exemplary Non-Limiting Embodiments

A. A targeted integration (TI) host cell comprising an exogenous nucleotide sequence integrated at an integration site within a specific locus of the genome of the host cell, wherein the locus is at least about 90% homologous to a sequence selected from SEQ ID Nos. 1-7.

A1. The TI host cell of A, wherein the nucleotide sequence immediately 5' of the integrated exogenous nucleotide sequence is selected from the group consisting of sequences at least about 90% homologous to nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, or nucleotides 82214-97705 of NW_003615411.1.

A2. The TI host cell of A wherein the nucleotide sequence immediately 5' of the integrated exogenous nucleotide sequence is selected from the group consisting of sequences at least 15 base pairs, at least 20 base pairs, at least 30 base pairs, at least 40 base pairs, at least 50 base pairs, at least 75 base pairs, at least 100 base pairs, at least 150 base pairs, at least 200 base pairs, at least 300 base pairs, at least 400 base pairs, at least 500 base pairs, at least 1,000 base pairs, at least 1,500 base pairs, at least 2,000 base pairs, at least 3,000 base pairs from nucleotide 45269 of NW_006874047.1, nucleotide 207911 of NW_006884592.1, nucleotide 491909 of NW_006881296.1, nucleotide 79768 of NW_003616412.1, nucleotide 315265 of NW_003615063.1, nucleotide 2662054 of NW_006882936.1, or nucleotide 97705 of NW_003615411.1.

A3. The TI host cell of A, wherein the nucleotide sequence immediately 3' of the integrated exogenous nucleotide sequence is selected from the group consisting of sequences at least about 90% homologous to nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, or nucleotides 97706-105117 of NW_003615411.1.

A4. The TI host cell of A wherein the nucleotide sequence immediately 3' of the integrated exogenous nucleotide sequence is selected from the group consisting of sequences at least 15 base pairs, at least 20 base pairs, at least 30 base pairs, at least 40 base pairs, at least 50 base pairs, at least 75 base pairs, at least 100 base pairs, at least 150 base pairs, at least 200 base pairs, at least 300 base pairs, at least 400 base pairs, at least 500 base pairs, at least 1,000 base pairs, at least 1,500 base pairs, at least 2,000 base pairs, at least 3,000 base pairs from nucleotide 45270 of NW_006874047.1, nucleotide 207912 of NW_006884592.1, nucleotide 491910 of NW_006881296.1, nucleotide 79769 of NW_003616412.1, nucleotide 315266 of NW_003615063.1, nucleotide 2662055 of NW_006882936.1, or nucleotide 97706 of NW_003615411.1

A5. The TI host cell of any one of A-A4, wherein the integrated exogenous nucleotide sequence is operably linked to a nucleotide sequence selected from the group consisting of sequences at least about 90% homologous to a sequence selected from SEQ ID Nos. 1-7.

A6. A TI host cell comprising an exogenous nucleotide sequence integrated at an integration site within an endogenous gene selected from the group consisting of LOC107977062, LOC100768845, ITPR2, ERE67000.1, UBAP2, MTMR2, XP_003512331.2, and sequences at least about 90% homologous thereto.

A7. A TI host cell comprising an exogenous nucleotide sequence integrated at an integration site operably linked to an endogenous gene selected from the group consisting of LOC107977062, LOC100768845, ITPR2, ERE67000.1, UBAP2, MTMR2, XP_003512331.2, and sequences at least about 90% homologous thereto.

A8. A TI host cell comprising an exogenous nucleotide sequence integrated at an integration site immediately adjacent to all or a portion of a sequence selected from the group consisting of sequences at least about 90% homologous to a sequence selected from SEQ ID Nos. 1-7.

A9. The TI host cell of any one of A-A8, wherein the TI host cell is a mammalian host cell.

A10. The TI host cell of A9, wherein the TI host cell is a hamster host cell, a human host cell, a rat host cell, or a mouse host cell.

A11. The TI host cell of A9 or A10, wherein the TI host cell is a Chinese hamster ovary (CHO) host cell, a CHO K1 host cell, a CHO KISV host cell, a DG44 host cell, a DUKXB-I1 host cell, a CHOK1S host cell, or a CHO KIM host cell.

A12. The TI host cell of any one of A-A11, wherein the exogenous nucleotide sequence comprises one or more recombination recognition sequences (RRSs), wherein the RRS can be recognized by a recombinase.

A13. The TI host cell of A12, wherein the exogenous nucleotide sequence comprises at least two RRSs.

A14. The TI host cell of A12 or A13, wherein the recombinase is a Cre recombinase or an FLP recombinase.

A15. The TI host cell of A12 or A13, wherein the recombinase is a Bxb1 integrase or a φC31 integrase.

A16. The TI host cell of any one of A12-A15, wherein the RRS is selected from the group consisting of a LoxP sequence, a LoxP L3 sequence, a LoxP 2 L sequence, a LoxFas sequence, a Lox511 sequence, a Lox2272 sequence, a Lox2372 sequence, a Lox5171 sequence, a Loxm2 sequence, a Lox71 sequence, a Lox66 sequence, a FRT sequence, a Bxb1 attP sequence, a Bxb1 attB sequence, a pC31 attP sequence, and a pC31 attB sequence.

A17. The TI host cell of any one of A13-A16, wherein the exogenous nucleotide sequence comprises a first and a second RRS, and at least one selection marker located between the first and the second RRS.

A18. The TI host cell of A17, comprising a first selection marker, wherein the first selection marker is selected from the group consisting of aminoglycoside phosphotransferase (APH), hygromycin phosphotransferase (HYG), neomycin, G418 APH), dihydrofolate reductase (DHFR), thymidine kinase (TK), glutamine synthetase (GS), asparagine synthetase, tryptophan synthetase (indole), histidinol dehydrogenase (histidinol D), blasticidin, bleomycin, phleomycin, chloramphenicol, Zeocin, and mycophenolic acid.

A19. The TI host cell of A17 or A18, further comprising a second selection marker, wherein the first and the second selection markers are different.

A20. The TI host cell of A19, wherein the second selection marker is selected from the group consisting of aminoglycoside phosphotransferase (APH), hygromycin phosphotransferase (HYG), neomycin, G418 APH), dihydrofolate reductase (DHFR), thymidine kinase (TK), glutamine synthetase (GS), asparagine synthetase, tryptophan synthetase (indole), histidinol dehydrogenase (histidinol D), blasticidin, bleomycin, phleomycin, chloramphenicol, Zeocin, and mycophenolic acid.

A21. The TI host cell of A19 or A20, further comprising a third selection marker and an internal ribosome entry site (IRES), wherein the IRES is operably linked to the third selection marker.

A22. The TI host cell of A21, wherein the third selection marker is different from the first or the second selection marker.

A23. The TI host cell of A21 or A22, wherein the third selection marker is selected from the group consisting of a green fluorescent protein (GFP) marker, an enhanced GFP (eGFP) marker, a synthetic GFP marker, a yellow fluorescent protein (YFP) marker, an enhanced YFP (eYFP) marker, a cyan fluorescent protein (CFP) marker, a mPlum marker, a mCherry marker, a tdTomato marker, a mStrawberry marker, a J-red marker, a DsRed-monomer marker, a mOrange marker, a mKO marker, a mCitrine marker, a Venus marker, a YPet marker, an Emerald6 marker, a CyPet marker, a mCFPm marker, a Cerulean marker, and a T-Sapphire marker.

A24. The TI host cell of anyone of A17-A23, further comprising a third RRS, wherein the third RRS is located between the first and the second RRS, and the third RRS is heterospecific relative the first or the second RRS.

A25. The TI host cell of any one of A12-A24, wherein the exogenous nucleotide sequence comprises at least one selection marker and at least one exogenous sequence of interest (SOI).

A26. The TI host cell any one of A12-A25, wherein the exogenous nucleotide sequence further comprises at least one exogenous SOI.

A27. The TI host cell of A26, wherein the exogenous SOI is located between the first and the second RRS.

A28. The TI host cell of A26 or A27, wherein the SOI encodes a single chain antibody, an antibody light chain, an antibody heavy chain, a single-chain Fv fragment (scFv), or an Fc fusion protein.

A29. The TI host cell of any one of A24-A28, wherein the exogenous nucleotide sequence further comprises at least one exogenous SOI located between the first and the third RRS, and at least one exogenous SOI located between the third and the second RRS.

A30. The TI host cell of A29, wherein the SOI encodes a single chain antibody, an antibody light chain, an antibody heavy chain, a single-chain Fv fragment (scFv), or an Fc fusion protein.

A31. The TI host cell of A26 wherein the SOI encodes an antibody expressed at a higher level relative to a randomly integrated host cell.

A32. The TI host cell of A31 where the antibody is a standard or half antibodies expressed at a titer of at least 3 g/L, 3.5 g/L, 4 g/L, 4.5 g/L, 5 g/L, 5.5 g/L, 6 g/L, 6.5 g/L, 7 g/L, 7.5 g/L, 8 g/L, 8.5 g/L, 9 g/L, 9.5 g/L, 10 g/L, 10.5 g/L, 11 g/L, or more, A33. The TI host cell of A31 where the antibody is a multispecific antibody, e.g., a bispecific antibody, expressed at a titer of at least 1.5 g/L, 2 g/L, 2.5 g/L, 3 g/L, 3.5 g/L, 4 g/L, 4.5 g/L, 5 g/L, 5.5 g/L, 6 g/L.

A34. The TI host cell of A31 where the antibody is a bispecific antibody and the bispecific content is increased relative to a random integration host cell.

A35. The TI host cell of A1 wherein the antibody is a bispecific antibody and the bispecific content is at least 80%, 85%, 90%, 95%, 96%, 98%, 99% or more.

B. A method of preparing a TI host cell expressing a polypeptide of interest comprising: providing a TI host cell comprising an exogenous nucleotide sequence integrated at a site within a locus of the genome of the TI host cell, wherein the locus is at least about 90% homologous to a sequence selected from SEQ ID No. 1-7, wherein the exogenous nucleotide sequence comprises two RRSs, flanking at least one first selection marker; introducing into the cell provided in a) a vector comprising two RRSs matching the two RRSs on the integrated exogenous nucleotide sequence and flanking at least one exogenous SOI and at least one second selection marker; introducing a recombinase or a nucleic acid encoding a recombinase, wherein the recombinase recognizes the RRSs; and selecting for TI cells expressing the second selection marker to thereby isolate a TI host cell expressing the polypeptide.

B1. The method of B, wherein the recombinase is Cre recombinase or an FLP recombinase.

B2. The method of B, wherein the recombinase is a Bxb1 integrase or a pC31 integrase.

B3. The method of any one of B-B2, wherein the SOI encodes a single chain antibody, an antibody light chain, an antibody heavy chain, a single-chain Fv fragment (scFv), or an Fc fusion protein.

B4. The method of any one of claims B-B3, wherein the TI host cell is a mammalian host cell.

B5. The method of B4, wherein the TI host cell is a hamster host cell, a human host cell, a rat host cell, or a mouse host cell.

B6. The method of B4 or B5, wherein the TI host cell is a CHO host cell, a CHO K1 host cell, a CHO K1SV host cell, a DG44 host cell, a DUKXB-11 host cell, a CHOK1S host cell, or a CHO KIM host cell.

C. A method for expressing a polypeptide of interest comprising: providing a TI host cell comprising at least one exogenous SOI and at least one selection marker where the at least one exogenous SOI and at least one selection marker are flanked by two RRSs integrated within a locus of the genome of the TI host cell, wherein the locus is at least about 90% homologous to a sequence selected from SEQ ID Nos. 1-7; and culturing the cell in a) under conditions suitable for expressing the polypeptide of interest and recovering a polypeptide of interest therefrom.

C1. The method of C, wherein the at least one exogenous SOI encodes a single chain antibody, an antibody light chain, an antibody heavy chain, a single-chain Fv fragment (scFv), or an Fc fusion protein.

D. A method for preparing a TI host cell expressing at least a first and second polypeptide of interest comprising: providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first and a second RRS flanking at least one first selection marker, and a third RRS located between the first and the second RRS, and all the RRSs are heterospecific; introducing into the cell provided in a) a first vector comprising two RRSs matching the first and the third RRS on the integrated exogenous nucleotide sequence and flanking at least one first exogenous SOI and at least one second selection marker; introducing into the cell provided in a) a second vector comprising two RRSs matching the second and the third RRS on the integrated exogenous nucleotide sequence and flanking at least one second exogenous SOI; introducing one or more recombinases, or one or more nucleic acids encoding one or more recombinases, wherein the one or more recombinases recognize the RRSs; and selecting for TI cells expressing the second selection marker to thereby isolate a TI host cell expressing the first and second polypeptides of interest.

D1. The method of D, wherein the recombinase is Cre recombinase or an FLP recombinase.

D2. The method of D, wherein the recombinase is a Bxb1 integrase or a φpC31 integrase.

D3. The method of D, wherein: the first vector further comprises a promoter sequence operably linked to the codon ATG positioned flanked upstream by the first SOI and downstream by an RRS; and the second vector further comprises a selection marker lacking an ATG transcription start codon flanked upstream by an RRS and downstream by the second SOI.

D4. The method of any one of D-D3, wherein the first SOI encodes a single chain antibody, an antibody light chain, an antibody heavy chain, a single-chain Fv fragment (scFv), or an Fc fusion protein.

D5. The method of any one of D-D3, wherein the second SOI encodes a single chain antibody, an antibody light chain, an antibody heavy chain, a single-chain Fv fragment (scFv), or an Fc fusion protein.

D6. The method of any one of C or D-D5, wherein the TI host cell is a mammalian host cell.

D7. The method of D6, wherein the TI host cell is a hamster host cell, a human host cell, a rat host cell, or a mouse host cell.

D8. The method of D7, wherein the TI host cell is a CHO host cell, a CHO K1 host cell, a CHO K1 SV host cell, a DG44 host cell, a DUKXB-11 host cell, a CHOK1S host cell, or a CHO K1M host cell.

E. A method for expressing a polypeptide of interest comprising: providing a host cell comprising at least two exogenous SOIs and at least one selection marker integrated within a locus of the genome of the host cell, wherein the locus is at least about 90% homologous to a sequence selected from SEQ ID Nos 1-7, wherein at least one exogenous SOI and one selection marker is flanked by a first and a third RRS and at least one exogenous SOI is flanked by a second and the third RRS; and culturing the cell in a) under conditions suitable for expressing the polypeptide of interest and recovering a polypeptide of interest therefrom.

E1. The method of E, wherein the first SOI encodes a single chain antibody, an antibody light chain, an antibody heavy chain, a single-chain Fv fragment (scFv), or an Fc fusion protein.

E2. The method of E or E1, wherein the second SOI encodes a single chain antibody, an antibody light chain, an antibody heavy chain, a single-chain Fv fragment (scFv), or an Fc fusion protein.

E3. The method of any one of E-E2, wherein the TI host cell is a mammalian host cell.

E4. The method of E3, wherein the TI host cell is a hamster host cell, a human host cell, a rat host cell, or a mouse host cell.

E5. The method of E4, wherein the TI host cell is a CHO host cell, a CHO K1 host cell, a CHO K1SV host cell, a DG44 host cell, a DUKXB-11 host cell, a CHOK1S host cell, or a CHO KIM host cell.

F. A vector comprising two nucleotide sequences at least 50% homologous to
  a) two reference sequences selected from any portion of SEQ ID No. 1;
  b) two reference sequences selected from any portion of SEQ ID No. 2;
  c) two reference sequences selected from any portion of SEQ ID No. 3;
  d) two reference sequences selected from any portion of SEQ ID No. 4;
  e) two reference sequences selected from any portion of SEQ ID No 5;
  f) two reference sequences selected from any portion of SEQ ID No. 6; or
  g) two reference sequences selected from any portion of SEQ ID No. 7, wherein said sequences flank a DNA cassette, wherein the DNA cassette comprises at least one selection marker and at least one exogenous SOI flanked by two RRSs.

F1. The vector of F, wherein the vector comprises two nucleotide sequences at least 60% homologous to the two reference sequences.

F2. The vector of F, wherein the vector comprises two nucleotide sequences at least 70% homologous to the two reference sequences.

F3. The vector of F, wherein the vector comprises two nucleotide sequences at least 80% homologous to the two reference sequences.

F4. The vector of F, wherein the vector comprises two nucleotide sequences at least 90% homologous to the two reference sequences.

F5. The vector of F, wherein the vector comprises two nucleotide sequences at least 95% homologous to the two reference sequences.

F6. The vector of F, wherein the vector comprises two nucleotide sequences at least 99% homologous to the two reference sequences.

F7. The vector of any of F-F6, wherein the vector is selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid.

F8. The vector of any of F-F7, wherein the SOI encodes a single chain antibody, an antibody light chain, an antibody heavy chain, a single-chain Fv fragment (scFv), or an Fc fusion protein.

G. A method for preparing a TI host cell expressing a polypeptide of interest comprising: providing a host cell comprising a locus of the genome of the host cell, wherein the locus is at least about 90% homologous to a sequence selected from SEQ ID Nos. 1-7; introducing a vector into the host cell, wherein the vector comprises nucleotide sequences at least 50% homologous to a sequence selected from SEQ ID Nos. 1-7 flanking a DNA cassette, wherein the DNA cassette comprises at least one selection marker and at least one exogenous SOI flanked by two RRSs; and selecting for the selection marker to isolate a TI host cell with the SOI integrated in the locus of the genome and expressing the polypeptide of interest.

G1. The method of G, wherein the vector is selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid.

G2. The method of G or G1, wherein the at least one SOI encodes a single chain antibody, an antibody light chain, an antibody heavy chain, a single-chain Fv fragment (scFv), or an Fc fusion protein.

G3. The method of any one of G-G2, wherein the TI host cell is a mammalian host cell.

G4. The method of G3, wherein the TI host cell is a hamster host cell, a human host cell, a rat host cell, or a mouse host cell.

G5. The method of G3 or G4, wherein the TI host cell is a CHO host cell, a CHO K1 host cell, a CHO K1SV host cell, a DG44 host cell, a DUKXB-I host cell, a CHOK1S host cell, or a CHO KIM host cell.

G6. The method of any one of G1-G5, wherein the integration of the nucleic acid comprising the at least one SOI and selection marker is promoted by an exogenous nuclease.

G7. The method of G6, wherein the exogenous nuclease is selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

G8. The method of G, wherein the polypeptide of interest is a multispecific antibody.

G9. The method of G8, wherein the multispecific antibody is a bispecific antibody.

H. A TI host cell comprising at least one exogenous nucleotide sequence integrated at an integration site within one or more specific loci of the genome of the host cell, wherein the locus is at least about 90% homologous to a sequence selected from SEQ ID Nos. 1-7.

H1. A TI host cell comprising at least one exogenous nucleotide sequence integrated at one or more integration sites within an endogenous gene selected from the group consisting of LOC107977062, LOC100768845, ITPR2, ERE67000.1, UBAP2, MTMR2, XP_003512331.2, and sequences at least about 90% homologous thereto.

H2. The TI host cell of any one of H-H1, wherein the at least one exogenous nucleotide sequence comprises one or more recombination recognition sequences (RRSs), wherein the RRS can be recognized by a recombinase.

H3. The TI host cell of H2, wherein the at least one exogenous nucleotide sequence further comprises at least one exogenous SOI.

H4. The TI host cell of any of H-H3, wherein the host cell comprises at least one exogenous nucleotide sequence at a first locus of the genome of the host cell and at least one exogenous nucleotide sequence at one or more secondary locus of the genome of the host cell.

H5. The TI host cell of H4 where the first locus comprises a sequence at least 90% homologous to all or a portion SEQ ID No. 1 and the secondary locus comprises at least one sequence at least 90% homologous to all or a portion of SEQ ID No. 2, SEQ ID No. 3, SEQ ID No. 4, SEQ ID No. 5, SEQ ID No. 6, or SEQ ID No. 7.

H5.1. The TI host cell of H4 where the first locus comprises a sequence at least 90% homologous to all or a portion SEQ ID No. 1 and the secondary locus comprises at least one sequence at least 90% homologous to all or a portion of SEQ ID No. 2.

H5.2. The TI host cell of H4 where the first locus comprises a sequence at least 90% homologous to all or a portion SEQ ID No. 1 and the secondary locus comprises at least one sequence at least 90% homologous to all or a portion of SEQ ID No. 3.

H5.3. The TI host cell of H4 where the first locus comprises a sequence at least 90% homologous to all or a portion SEQ ID No. 1 and the secondary locus comprises at least one sequence at least 90% homologous to all or a portion of SEQ ID No. 4.

H5.4. The TI host cell of H4 where the first locus comprises a sequence at least 90% homologous to all or a portion SEQ ID No. 1 and the secondary locus comprises at least one sequence at least 90% homologous to all or a portion of SEQ ID No. 5.

H5.5. The TI host cell of H4 where the first locus comprises a sequence at least 90% homologous to all or a portion SEQ ID No. 1 and the secondary locus comprises at least one sequence at least 90% homologous to all or a portion of SEQ ID No. 6.

H5.6. The TI host cell of H4 where the first locus comprises a sequence at least 90% homologous to all or a portion SEQ ID No. 1 and the secondary locus comprises at least one sequence at least 90% homologous to all or a portion of SEQ ID No. 7.

H6. The TI host cell of H4 where the first locus comprises a sequence at least 90% homologous to all or a portion SEQ ID No. 2 and the secondary locus comprises at least one sequence at least 90% homologous to all or a portion of SEQ ID No. 1, SEQ ID No. 3, SEQ ID No. 4, SEQ ID No. 5, SEQ ID No. 6, or SEQ ID No. 7.

H6.1. The TI host cell of H4 where the first locus comprises a sequence at least 90% homologous to all or a portion SEQ ID No. 2 and the secondary locus comprises at least one sequence at least 90% homologous to all or a portion of SEQ ID No. 1.

H6.2. The TI host cell of H4 where the first locus comprises a sequence at least 90% homologous to all or a portion SEQ ID No. 2 and the secondary locus comprises at least one sequence at least 90% homologous to all or a portion of SEQ ID No. 3.

H6.3. The TI host cell of H4 where the first locus comprises a sequence at least 90% homologous to all or a portion SEQ ID No. 2 and the secondary locus comprises at least one sequence at least 90% homologous to all or a portion of SEQ ID No. 4.

H6.4. The TI host cell of H4 where the first locus comprises a sequence at least 90% homologous to all or a portion SEQ ID No. 2 and the secondary locus comprises at least one sequence at least 90% homologous to all or a portion of SEQ ID No. 5.

H6.5. The TI host cell of H4 where the first locus comprises a sequence at least 90% homologous to all or a portion SEQ ID No. 2 and the secondary locus comprises at least one sequence at least 90% homologous to all or a portion of SEQ ID No. 6.

H6.6. The TI host cell of H4 where the first locus comprises a sequence at least 90% homologous to all or a portion SEQ ID No. 2 and the secondary locus comprises at least one sequence at least 90% homologous to all or a portion of SEQ ID No. 7.

H7. The TI host cell of H4 where the first locus comprises a sequence at least 90% homologous to all or a portion SEQ ID No. 3 and the secondary locus comprises at least one sequence at least 90% homologous to all or a portion of SEQ ID No. 1, SEQ ID No. 2, SEQ ID No. 4, SEQ ID No. 5, SEQ ID No. 6, or SEQ ID No. 7.

H7.1. The TI host cell of H4 where the first locus comprises a sequence at least 90% homologous to all or a portion SEQ ID No. 3 and the secondary locus comprises at least one sequence at least 90% homologous to all or a portion of SEQ ID No. 1.

H7.2. The TI host cell of H4 where the first locus comprises a sequence at least 90% homologous to all or a portion SEQ ID No. 3 and the secondary locus comprises at least one sequence at least 90% homologous to all or a portion of SEQ ID No. 2.

H7.3. The TI host cell of H4 where the first locus comprises a sequence at least 90% homologous to all or a portion SEQ ID No. 3 and the secondary locus comprises at least one sequence at least 90% homologous to all or a portion of SEQ ID No. 4.

H7.4. The TI host cell of H4 where the first locus comprises a sequence at least 90% homologous to all or a portion SEQ ID No. 3 and the secondary locus comprises at least one sequence at least 90% homologous to all or a portion of SEQ ID No. 5.

H7.5. The TI host cell of H4 where the first locus comprises a sequence at least 90% homologous to all or a portion SEQ ID No. 3 and the secondary locus comprises at least one sequence at least 90% homologous to all or a portion of SEQ ID No. 6.

H7.6. The TI host cell of H4 where the first locus comprises a sequence at least 90% homologous to all or a portion SEQ ID No. 3 and the secondary locus comprises at least one sequence at least 90% homologous to all or a portion of SEQ ID No. 7.

H8. The TI host cell of H4 where the first locus comprises a sequence at least 90% homologous to all or a portion SEQ ID No. 4 and the secondary locus comprises at least one sequence at least 90% homologous to all or a portion of SEQ ID No. 1, SEQ ID No. 2, SEQ ID No. 3, SEQ ID No. 5, SEQ ID No. 6, or SEQ ID No. 7.

H8.1. The TI host cell of H4 where the first locus comprises a sequence at least 90% homologous to all or a portion SEQ ID No. 4 and the secondary locus comprises at least one sequence at least 90% homologous to all or a portion of SEQ ID No. 1.

H8.2. The TI host cell of H4 where the first locus comprises a sequence at least 90% homologous to all or a portion SEQ ID No. 4 and the secondary locus comprises at least one sequence at least 90% homologous to all or a portion of SEQ ID No. 2.

H8.3. The TI host cell of H4 where the first locus comprises a sequence at least 90% homologous to all or a portion SEQ ID No. 4 and the secondary locus comprises at least one sequence at least 90% homologous to all or a portion of SEQ ID No. 3.

H8.4. The TI host cell of H4 where the first locus comprises a sequence at least 90% homologous to all or a portion SEQ ID No. 4 and the secondary locus comprises at least one sequence at least 90% homologous to all or a portion of SEQ ID No. 5.

H8.5. The TI host cell of H4 where the first locus comprises a sequence at least 90% homologous to all or a portion SEQ ID No. 4 and the secondary locus comprises at least one sequence at least 90% homologous to all or a portion of SEQ ID No. 6.

H8.6. The TI host cell of H4 where the first locus comprises a sequence at least 90% homologous to all or a portion SEQ ID No. 4 and the secondary locus comprises at least one sequence at least 90% homologous to all or a portion of SEQ ID No. 7.

H9. The TI host cell of H4 where the first locus comprises a sequence at least 90% homologous to all or a portion SEQ ID No. 5 and the secondary locus comprises at least one sequence at least 90% homologous to all or a portion of SEQ ID No. 1, SEQ ID No. 2, SEQ ID No. 3, SEQ ID No. 4, SEQ ID No. 6, or SEQ ID No. 7.

H9.1. The TI host cell of H4 where the first locus comprises a sequence at least 90% homologous to all or a portion SEQ ID No. 5 and the secondary locus comprises at least one sequence at least 90% homologous to all or a portion of SEQ ID No. 1.

H9.2. The TI host cell of H4 where the first locus comprises a sequence at least 90% homologous to all or a portion SEQ ID No. 5 and the secondary locus comprises at least one sequence at least 90% homologous to all or a portion of SEQ ID No. 2.

H9.3. The TI host cell of H4 where the first locus comprises a sequence at least 90% homologous to all or a portion SEQ ID No. 5 and the secondary locus comprises at least one sequence at least 90% homologous to all or a portion of SEQ ID No. 3.

H9.4. The TI host cell of H4 where the first locus comprises a sequence at least 90% homologous to all or a portion SEQ ID No. 5 and the secondary locus comprises at least one sequence at least 90% homologous to all or a portion of SEQ ID No. 4.

H9.5. The TI host cell of H4 where the first locus comprises a sequence at least 90% homologous to all or a portion SEQ ID No. 5 and the secondary locus comprises at least one sequence at least 90% homologous to all or a portion of SEQ ID No. 6.

H9.6. The TI host cell of H4 where the first locus comprises a sequence at least 90% homologous to all or a portion SEQ ID No. 5 and the secondary locus comprises at least one sequence at least 90% homologous to all or a portion of SEQ ID No. 7.

H10. The TI host cell of H4 where the first locus comprises a sequence at least 90% homologous to all or a portion SEQ ID No. 6 and the secondary locus comprises at least one sequence at least 90% homologous to all or a portion of SEQ ID No. 1, SEQ ID No. 2, SEQ ID No. 3, SEQ ID No. 4, SEQ ID No. 5, or SEQ ID No. 7.

H10.1. The TI host cell of H4 where the first locus comprises a sequence at least 90% homologous to all or a portion SEQ ID No. 6 and the secondary locus comprises at least one sequence at least 90% homologous to all or a portion of SEQ ID No. 1.

H10.2. The TI host cell of H4 where the first locus comprises a sequence at least 90% homologous to all or a portion SEQ ID No. 6 and the secondary locus comprises at least one sequence at least 90% homologous to all or a portion of SEQ ID No. 2.

H10.3. The TI host cell of H4 where the first locus comprises a sequence at least 90% homologous to all or a portion SEQ ID No. 6 and the secondary locus comprises at least one sequence at least 90% homologous to all or a portion of SEQ ID No. 3.

H10.4. The TI host cell of H4 where the first locus comprises a sequence at least 90% homologous to all or a portion SEQ ID No. 6 and the secondary locus comprises at least one sequence at least 90% homologous to all or a portion of SEQ ID No. 4.

H10.5. The TI host cell of H4 where the first locus comprises a sequence at least 90% homologous to all or a portion SEQ ID No. 6 and the secondary locus comprises at least one sequence at least 90% homologous to all or a portion of SEQ ID No. 5.

H10.6. The TI host cell of H4 where the first locus comprises a sequence at least 90% homologous to all or a portion SEQ ID No. 6 and the secondary locus comprises at least one sequence at least 90% homologous to all or a portion of SEQ ID No. 7.

H11. The TI host cell of H4 where the first locus comprises a sequence at least 90% homologous to all or a portion SEQ ID No. 7 and the secondary locus comprises at least one sequence at least 90% homologous to all or a portion of SEQ ID No. 1, SEQ ID No. 2, SEQ ID No. 3, SEQ ID No. 4, SEQ ID No. 5, or SEQ ID No. 6.

H11.1. The TI host cell of H4 where the first locus comprises a sequence at least 90% homologous to all or a portion SEQ ID No. 7 and the secondary locus comprises at least one sequence at least 90% homologous to all or a portion of SEQ ID No. 1.

H11.2. The TI host cell of H4 where the first locus comprises a sequence at least 90% homologous to all or a portion SEQ ID No. 7 and the secondary locus comprises at least one sequence at least 90% homologous to all or a portion of SEQ ID No. 2.

H11.3. The TI host cell of H4 where the first locus comprises a sequence at least 90% homologous to all or a portion SEQ ID No. 7 and the secondary locus comprises at least one sequence at least 90% homologous to all or a portion of SEQ ID No. 3.

H11.4. The TI host cell of H4 where the first locus comprises a sequence at least 90% homologous to all or a portion SEQ ID No. 7 and the secondary locus comprises at least one sequence at least 90% homologous to all or a portion of SEQ ID No. 4.

H11.5. The TI host cell of H4 where the first locus comprises a sequence at least 90% homologous to all or a portion SEQ ID No. 7 and the secondary locus comprises at least one sequence at least 90% homologous to all or a portion of SEQ ID No. 5.

H11.6. The TI host cell of H4 where the first locus comprises a sequence at least 90% homologous to all or a portion SEQ ID No. 7 and the secondary locus comprises at least one sequence at least 90% homologous to all or a portion of SEQ ID No. 6.

H12. The TI host cell of H4 where the first locus is an integration sites within an LOC107977062 gene and the secondary locus is an integration site within a gene selected from the following group: LOC100768845, ITPR2, ERE67000.1, UBAP2, MTMR2, XP_003512331.2, and sequences at least about 90% homologous thereto.

H13. The TI host cell of H4 where the first locus is an integration sites within an LOC100768845 gene and the secondary locus is an integration site within a gene selected from the following group: LOC107977062, ITPR2, ERE67000.1, UBAP2, MTMR2, XP_003512331.2, and sequences at least about 90% homologous thereto.

H14. The TI host cell of H4 where the first locus is an integration sites within an ITPR2 gene and the secondary locus is an integration site within a gene selected from the following group: LOC107977062, LOC100768845, ERE67000.1, UBAP2, MTMR2, XP_003512331.2, and sequences at least about 90% homologous thereto.

H15. The TI host cell of H4 where the first locus is an integration sites within an ERE67000.1 gene and the secondary locus is an integration site within a gene selected from the following group: LOC107977062, LOC100768845, ITPR2, UBAP2, MTMR2, XP_003512331.2, and sequences at least about 90% homologous thereto.

H16. The TI host cell of H4 where the first locus is an integration sites within an UBAP2 gene and the secondary locus is an integration site within a gene selected from the following group: LOC107977062, LOC100768845, ITPR2, ERE67000.1, MTMR2, XP_003512331.2, and sequences at least about 90% homologous thereto.

H17. The TI host cell of H4 where the first locus is an integration sites within an MTMR2 gene and the secondary locus is an integration site within a gene selected from the following group LOC107977062, LOC100768845, ITPR2, ERE67000.1, UBAP2, XP_003512331.2, and sequences at least about 90% homologous thereto.

H18. The TI host cell of H4 where the first locus is an integration sites within an XP_003512331.2 gene and the secondary locus is an integration site within a gene selected from the following group: LOC107977062, LOC100768845, ITPR2, ERE67000.1, UBAP2, MTMR2, and sequences at least about 90% homologous thereto.

H19. The TI host cell of H4-H18 wherein the at least one exogenous nucleotide sequence incorporated at the first locus comprises a regulatable promotor.

H20. The TI host cell of H4-H18, wherein the at least one exogenous nucleotide sequence incorporated at the secondary locus comprises a regulatable promoter.

H21. The TI host cell of H4-H18, where the at least one exogenous nucleotide sequence incorporated at the first locus and the at least one nucleotide sequence incorporated at the secondary locus comprise a regulatable promoter.

J. A method of preparing a TI host cell expressing at least one polypeptide of interest comprising: providing a TI host cell comprising at least one exogenous nucleotide sequence integrated at a site within one or more loci of the genome of the TI host cell, wherein the one or more loci are at least about 90% homologous to a sequence selected from SEQ ID No. 1-7, wherein the at least one exogenous nucleotide sequence comprises two RRSs, flanking at least one first selection marker; introducing into the cell provided in a) a vector comprising two RRSs matching the two RRSs on the integrated exogenous nucleotide sequence and flanking at least one exogenous SOI and at least one second selection marker; introducing a recombinase or a nucleic acid encoding a recombinase, wherein the recombinase recognizes the RRSs; and selecting for TI cells expressing the second selection marker to thereby isolate a TI host cell expressing the at least one polypeptide of interest.

J1. A method for preparing a TI host cell expressing at least one first and second polypeptide of interest comprising: providing a TI host cell comprising at least one exogenous nucleotide sequence integrated at a site within one or more loci of the genome of the host cell, wherein one or more loci are at least about 90% homologous to a sequence selected from SEQ ID Nos. 1-7, wherein the exogenous nucleotide sequence comprises a first and a second RRS flanking at least one first selection marker, and a third RRS located between the first and the second RRS, and all the RRSs are heterospecific; introducing into the cell provided in a) a first vector comprising two RRSs matching the first and the third RRS on the at least one integrated exogenous nucleotide sequence and flanking at least one first exogenous SOI and at least one second selection marker; introducing into the cell provided in a) a second vector comprising two RRSs matching the second and the third RRS on the at least one integrated exogenous nucleotide sequence and flanking at least one second exogenous SOI; introducing one or more recombinases, or one or more nucleic acids encoding one or more recombinases, wherein the one or more recombinases recognize the RRSs; and selecting for TI cells expressing the second selection marker to thereby isolate a TI host cell expressing the at least one first and second polypeptides of interest.

J2. A method of preparing a TI host cell expressing a polypeptide of interest comprising: a) providing a TI host cell comprising at least one exogenous nucleotide sequence integrated at a site within one or more loci of the genome of the TI host cell, wherein the one or more loci are at least about 90% homologous to a sequence selected from SEQ ID No. 1-7, wherein the exogenous nucleotide sequence comprises one or more RRSs; b) introducing into the cell provided in a) a vector comprising one or more RRSs matching the one or more RRSs on the integrated exogenous nucleotide sequence and flanking at least one exogenous SOI and operably linked to at least one regulatable promoter; c) introducing a recombinase or a nucleic acid encoding a recombinase, wherein the recombinase recognizes the RRSs; and d) selecting for TI cells expressing the exogenous polypeptide of interest in the presence of an inducer to thereby isolate a TI host cell expressing the polypeptide of interest.

J3. A method for expressing a polypeptide of interest comprising: a) providing a host cell comprising at least one exogenous SOI flanked by two RRSs and a regulatable promoter integrated within a locus of the genome of the host cell, wherein the locus is at least about 90% homologous to a sequence selected from SEQ ID Nos. 1-7; and b) culturing the cell under conditions suitable for expressing the SOI and recovering a polypeptide of interest therefrom.

J4. A method for preparing a TI host cell expressing a first and second polypeptide of interest comprising: a) providing a TI host cell comprising an exogenous nucleotide sequence integrated at a site within a locus of the genome of the host cell, wherein the locus is at least about 90% homologous to a sequence selected from SEQ ID Nos. 1-7, wherein the exogenous nucleotide sequence comprises a first, second RRS and a third RRS located between the first and the second RRS, and all the RRSs are heterospecific; b) introducing into the cell provided in a) a first vector comprising two RRSs matching the first and the third RRS on the integrated exogenous nucleotide sequence and flanking at least one first exogenous SOI operably linked to a regulatable promoter; c) introducing into the cell provided in a) a second vector comprising two RRSs matching the second and the third RRS on the integrated exogenous nucleotide sequence and flanking at least one second exogenous SOI operably linked to a regulatable promoter; d) introducing one or more recombinases, or one or more nucleic acids encoding one or more recombinases, wherein the one or more recombinases recognize the RRSs; and e) selecting for TI cells expressing the first and second exogenous polypeptides of interest in the presence of an inducer to thereby isolate a TI host cell expressing the first and second polypeptides of interest.

J5. The method of any of claims J, J2, and J3, wherein the integration of a nucleic acid comprising at least one SOI is promoted by an exogenous nuclease.

J6. The method of claims J1 or J4, wherein the first SOI encodes a single chain antibody, an antibody light chain, an antibody heavy chain, a single-chain Fv fragment (scFv), or an Fc fusion protein; and the second SOI encodes a single chain antibody, an antibody light chain, an antibody heavy chain, a single-chain Fv fragment (scFv), or an Fc fusion protein.

J7. The method of J5, wherein the exogenous nuclease is selected from the group consisting of a zinc finger nuclease (ZFN), a ZFN dimer, a transcription activator-like effector nuclease (TALEN), a TAL effector domain fusion protein, an RNA-guided DNA endonuclease, an engineered meganuclease, and a clustered regularly interspaced short palindromic repeats (CRISPR)-associated (Cas) endonuclease.

J8. The method of any of claims J-J4, wherein the regulatable promoter is selected from the group consisting of SV40 and CMV promoters.

J9. The method of any of claims J2 and J4, wherein: the first vector further comprises a promoter sequence operably linked to the codon ATG positioned flanked upstream by the first SOI and downstream by an RRS; and the second vector further comprises a selection marker lacking an ATG transcription start codon flanked upstream by an RRS and downstream by the second SOI.

K. A vector comprising two nucleotide sequences at least 50% homologous to
 a) two reference sequences selected from any portion of SEQ ID No. 1;
 b) two reference sequences selected from any portion of SEQ ID No. 2;
 c) two reference sequences selected from any portion of SEQ ID No. 3;
 d) two reference sequences selected from any portion of SEQ ID No. 4;
 e) two reference sequences selected from any portion of SEQ ID No 5;
 f) two reference sequences selected from any portion of SEQ ID No. 6; or
 g) two reference sequences selected from any portion of SEQ ID No. 7,
 wherein the two nucleotide sequences flank a DNA cassette, wherein the DNA cassette comprises at least one exogenous SOI operably linked to a regulatable promoter and flanked by two RRSs.

K1. The vector of K, wherein the vector comprises two nucleotide sequences at least 60% homologous to the two reference sequences.

K2. The vector of K, wherein the vector comprises two nucleotide sequences at least 70% homologous to the two reference sequences.

K3. The vector of K, wherein the vector comprises two nucleotide sequences at least 80% homologous to the two reference sequences.

K4. The vector of K, wherein the vector comprises two nucleotide sequences at least 90% homologous to the two reference sequences.

K5. The vector of K, wherein the vector comprises two nucleotide sequences at least 95% homologous to the two reference sequences.

K6. The vector of K, wherein the vector comprises two nucleotide sequences at least 99% homologous to the two reference sequences.

K7. The vector of any of K-K6, wherein the vector is selected from the group consisting of an adenovirus vector, an adeno-associated virus vector, a lentivirus vector, a retrovirus vector, an integrating phage vector, a non-viral vector, a transposon and/or transposase vector, an integrase substrate, and a plasmid.

K8. The vector of any of K-K7, wherein the SOI encodes a single chain antibody, an antibody light chain, an antibody heavy chain, a single-chain Fv fragment (scFv), or an Fc fusion protein.

EXAMPLES

The following examples are merely illustrative of the presently disclosed subject matter and should not be considered as limitations in any way.

Example 1: Discovering Highly Productive Targeted Integration Sites for CHO Host Cells for Clinical and Commercial Cell Line Development This Example describes the methods for identifying targeted integration loci in the CHO genome having high productivity. Conventional cell line development (CLD) relies on the random integration (RI) of the plasmid carrying the sequence of interest (SOI). This process is unpredictable, and labor intensive. As such, a large effort is required to identify the high producing RI clones. Unlike the conventional RI CLD, targeted integration (TI) CLD introduces the transgene at a predetermined "hot-spot" in the CHO genome with a defined copy number (usually 1-2 copies). Given the low copy number and the pretested integration site, TI cell lines should have better stability compared to the RI lines. Moreover, since the selective marker is only used for selecting cells with proper TI and not for selecting cells with a high level of transgene expression, a less mutagenic marker may be applied to minimize the chance of sequence variants (SVs), which is in part due to the mutagenicity of the selective agents like methotrexate (MTX) or methionine sulfoximine (MSX).

Figure 1:
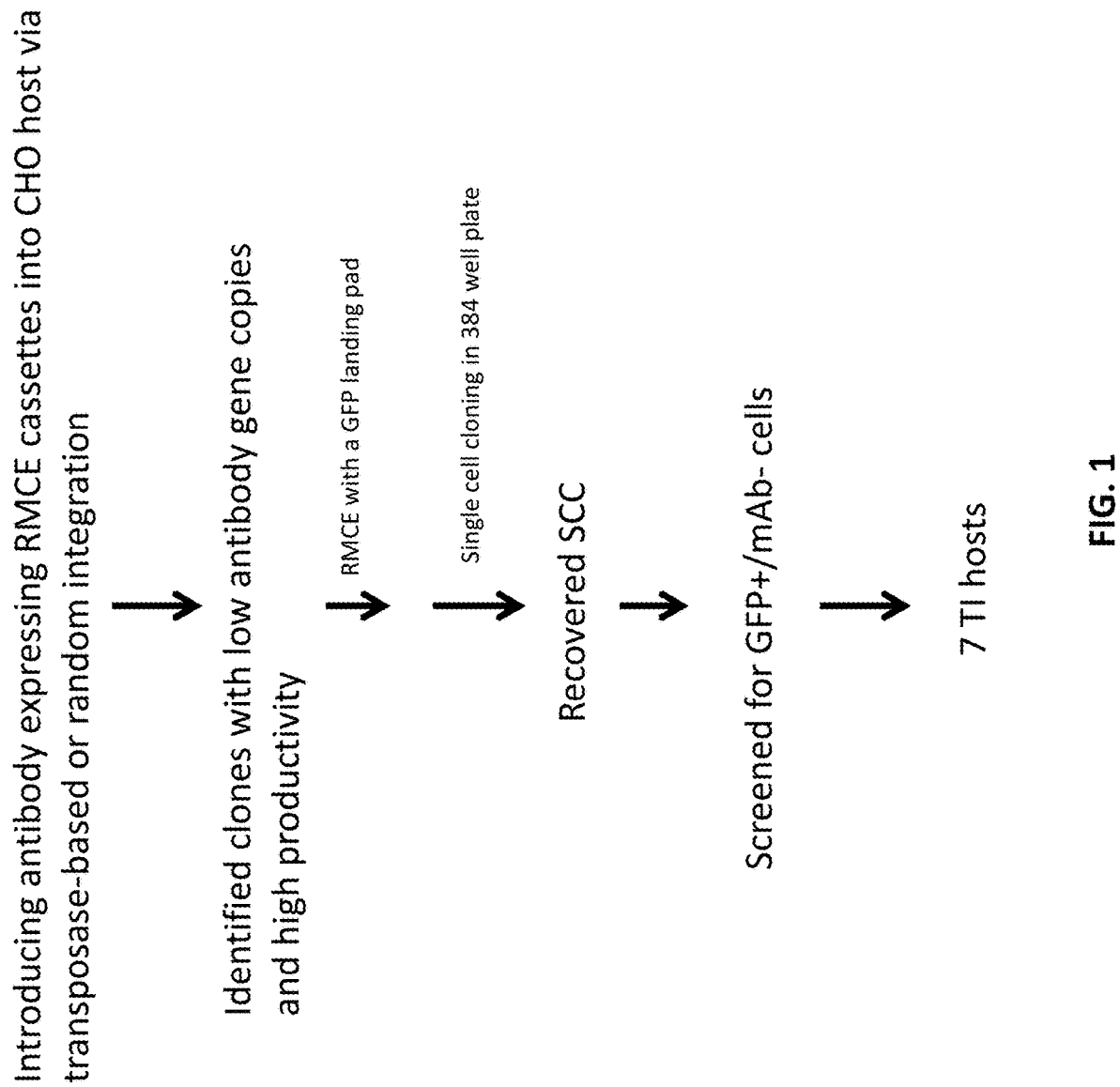
FIG. 1 is a diagram showing an outline of the genome-wide screening steps for identifying CHO TI loci that allow for stable and high expression of antibodies.

FIG. 1 is a diagram showing an outline of the genome-wide screening steps for identifying CHO TI loci that allow for stable and high expression of antibodies. To screen for transcriptionally active sequences in the CHO genome, two approaches were utilized to introduce an antibody cassette, expressing either antibody A or antibody B, and where the antibody sequences were flanked by RRS1 and RRS2, into the CHO genome. One approach was the conventional random integration method, and the other was a transposase-based integration that required cotransfection of a transposase expressing plasmid and the antibody plasmid. 15 k-20 k transfectants were screened for each of the methods. Based on an intact IgG ELISA assay and gene copy analysis, a total of ~300 clones with high antibody titer and low HC gene copy numbers were expanded for fed-batch evaluation in shake flasks. 40 clones, representing 40 potentially different highly transcriptionally active integration sites identified by the two methods, with acceptable titer and product quality attributes, were then selected for GFP landing pad swapping to generate TI hosts.

To replace the antibody cassette in the transcriptionally active loci, a landing pad that encoded a GFP gene and appropriate selection markers, flanked by the same RRS1 and RRS2, was constructed for RMCE. To initiate RMCE, the recombinase and the GFP landing pad were cotransfected into each of the 40 top clones. Two selection markers were used to enrich the targeted integration events. Successful RMCE should lead to the GFP landing pad being targeted to the transcriptionally active locus and replacing the antibody cassette, resulting in gain of GFP expression and loss of the antibody expression. The change in phenotype from GFP−/mAB+ to GFP+/mAb− should be readily detectable using FACS analysis. GFP+/mAb− enrichment was detected in 14 out of the 40 RMCE pools using FACS analysis. To isolate individual TI host candidates, each of these 14 RMCE pools was then single cell cloned. A total of 90 potential TI host candidates from the 14 pools were selected based on FACS and genomic PCR confirmation that the original antibody cassette was removed and replaced by the GFP landing pad at the integration sites of interest. Subsequently, some of these candidate hosts were evaluated for their RMCE capability and efficiency using a test antibody C flanked by the same RRS1 and RRS2. Two double selection schemes were utilized to generate the targeted antibody expressing population (FIGS. 2A and 2B), depending on which method the transcriptionally active locus was identified with. The configurations of the landing pads were slightly different for the two screening methods. Based on the RMCE efficiency as well as antibody productivity of the TI transfection pools, seven final hosts were selected, representing seven unique integration sites in the CHOK1M hosts for high antibody expression.

These seven hosts were analyzed by Targeted Locus Amplification/Next Generation Sequencing (TLA/NGS) to identify the CHO genomic sequences flanking the integration sites, thus providing the potential gene sequences the integration sites of interest reside in.

TABLE 2

TI host cell integration sites

| Host | Contig | Contig Size (kb) | Integration site (bp) | Gene (SEQ ID No.) |
|---|---|---|---|---|
| 1 | NW_006874047.1 (SEQ ID NO: 8) | 727 | 45269 | LOC107977062 (SEQ ID No. 1) |
| 2 | NW_006884592.1 (SEQ ID NO: 9) | 931 | 207911 | LOC100768845 (SEQ ID No. 2) |
| 3 | NW_006881296.1 (SEQ ID NO: 10) | 1016 | 491909 | ITPR2 (SEQ ID No. 3) |
| 4 | NW_003616412.1 (SEQ ID NO: 11) | 127 | 79768 | ERE67000.1 (SEQ ID No. 4) |
| 5 | NW_003615063.1 (SEQ ID NO: 12) | 372 | 315265 | UBAP2 (SEQ ID No. 5) |
| 6 | NW_006882936.1 (SEQ ID NO: 13) | 3042 | 2662054 | MTMR2 (SEQ ID No. 6) |
| 7 | NW_003615411.1 (SEQ ID NO: 14) | 277 | 97706 | XP_003512331.2 (SEQ ID No. 7) |

Based on the integration sites, 5' flanking sequences can include: nucleotides 41190-45269 of NW_006874047.1, nucleotides 63590-207911 of NW_006884592.1, nucleotides 253831-491909 of NW_006881296.1, nucleotides 69303-79768 of NW_003616412.1, nucleotides 293481-315265 of NW_003615063.1, nucleotides 2650443-2662054 of NW_006882936.1, and nucleotides 82214-97705 of NW_003615411.1.

Based on the integration sites, 3' flanking sequences can include: nucleotides 45270-45490 of NW_006874047.1, nucleotides 207912-792374 of NW_006884592.1, nucleotides 491910-667813 of NW_006881296.1, nucleotides 79769-100059 of NW_003616412.1, nucleotides 315266-362442 of NW_003615063.1, nucleotides 2662055-2701768 of NW_006882936.1, and nucleotides 97706-105117 of NW_003615411.1.

For two of the hosts, hosts 4 and 7, further analysis indicated that a single GFP landing pad was inserted into the CHO host genome. No antibody sequence was found in these two hosts, indicating the complete removal of the initial antibody cassettes used to identify the transcriptionally active loci. In addition, whole genome sequencing was performed in house for genomic DNA isolated from these two TI hosts. No antibody specific sequences were detected in these two TI hosts, while the GFP sequence (from the landing pad) was readily detected. More than 63x genome coverage was achieved for the TI hosts. To provide additional assurance of the absence of the antibody A and B in the TI hosts, multiple HCCF samples from TI cell lines expressing antibodies other than antibody A and B were evaluated using LC-MS study. The LC-MS data was analyzed using a similar approach to sequence variant analysis by LC-MS/MS, which has the ability to detect variant peptides at >0.5% level. No antibody A or B peptides were detected in all the samples harvested from the TI cell lines. Finally, a fluorescence in-situ hybridization (FISH) analysis was also performed by Chrombios to determine the chromosomal location of the GFP landing pad in the genome of these two TI hosts.

Figure 3:
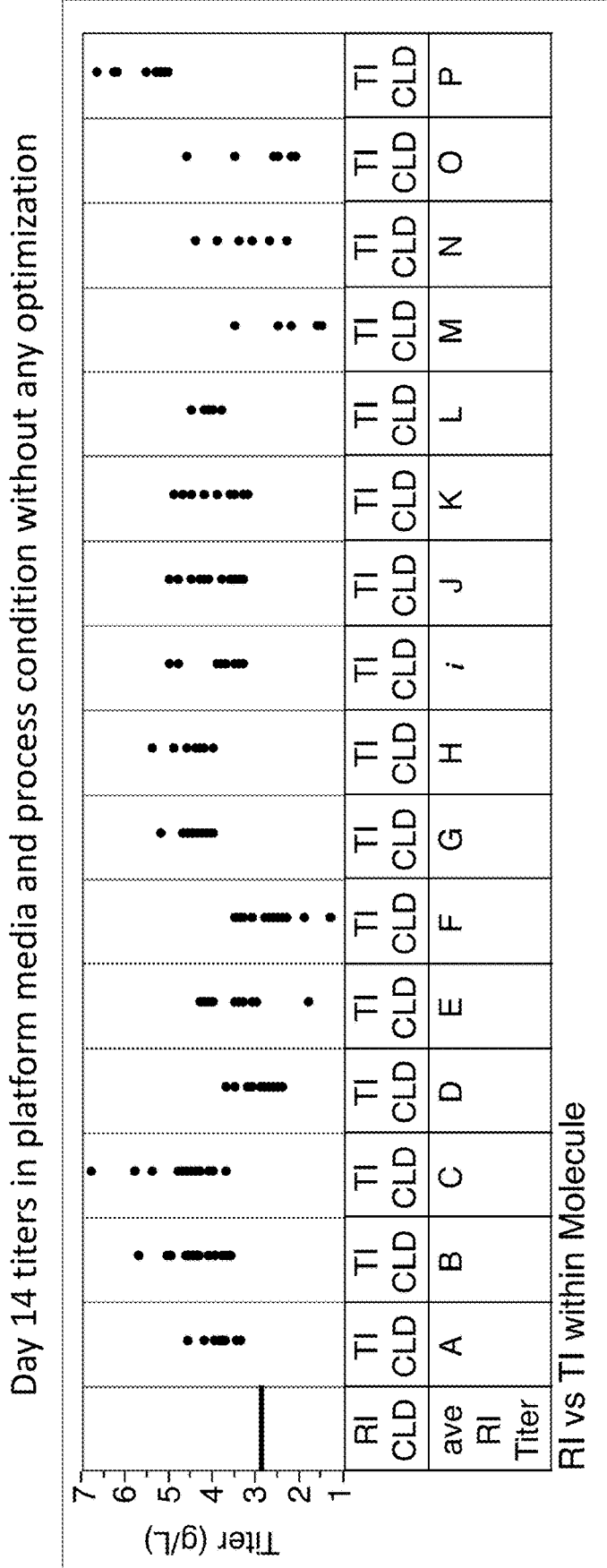
FIG. 3 depicts the productivity of the top clones generated by two particular TI hosts.

These two well-characterized TI hosts were further assessed for their RMCE robustness in clinical cell line development with a total of 16 different standard antibodies. FIG. 3 shows the productivity of the top clones generated by these TI hosts. Historically the average productivity of cell lines generated by random integration was ~3 g/L. In most cases tested, TI cell lines showed comparable or better productivity than RI clones on average.

TI cell lines were expected to have better stability and lower SV than RI cell lines due to lower antibody gene copy number. For clone stability, monthly fed-batch production was set up monthly for 4 months to monitor productivity. Table 3 showed that only 10% of the TI cell lines generated by one of the TI hosts had greater than 20% titer drop after 120 days from PSB. Historically, 60% of the RI cell lines would have similar titer drops. This strongly suggests that the integration site identified is highly suitable for stable antibody expression. TI cell lines were also subjected to NAT-based sequence variant analysis. There were significantly lower frequency of SV>5% in the TI cell lines when compared with the RI cell lines (4% vs 15%, Table 3).

TABLE 3

Advantages of TI vs RI

| Characteristics | RI | TI |
|---|---|---|
| Copy# | Clone dependent | Low |
| Clone Stability (>20% titer drop after 120 days from FSB) | ~60% of clones | ~10% of clones |
| Sequence Variants (SVs) (>5%) | ~15% of clones | ~4% of clones |

Example 2: Two-Plasmid RMCE Strategy

To address the challenge of achieving high titer expression for standard antibody and expressing multi-chain complex formats, an innovative two-plasmid RMCE strategy was developed. The two-plasmid RMCE method allows 8 or more chains to be targeted to a TI site at the same time. This approach not only increases the flexibility of modulating C and LC chain ratio of antibody to improve productivity, but also enables complex molecules with multiple chain as well as targeting transgenes, endogenous genes or RNAi with the antibody to modify cellular pathways.

The two-plasmid RMCE strategy involves using three RRS sites to carry out two independent RMCEs simultaneously (FIG. 4). Therefore, the GFP landing pad in the TI hosts described above was replaced to include a third RRS site (RRS3) that had no cross activity with either the RRS1 or RRS2 sites. The two expression plasmids to be targeted require the same flanking RRS sites for efficient targeting, one expression plasmid (front) flanked by RRS1 and RRS3 and the other (back) by RRS3 and RRS2. Since the two-plasmid RMCE efficiency is expected to below, astringent selection scheme is useful to enrich the rare RMCE specific events. At least two selection markers are needed in the two-plasmid RMCE. In certain embodiments three selection markers are employed, which one selection marker expression cassette split into two parts (see, e.g., FIG. 4). In certain embodiments involving a split selection marker expression cassette, the front plasmid would contain the promoter followed by a start codon and the RRS3 sequence. The back plasmid would have the RRS3 sequence fused to the N-terminus of the selection marker coding region, minus the ATG start. Additional nucleotides may need to be inserted between the RRS3 site and the selection marker sequence to ensure in frame translation for the fusion protein. Only when the two plasmids are correctly targeted would the full expression cassette of the selection marker be assembled thus rendering cells resistance to selection. FIG. 4 is the schematic diagram showing the two plasmid RMCE strategy. Of course, single-plasmid RMCE can still be carried out using RRS1 and RRS2, if needed.

Figure 5:
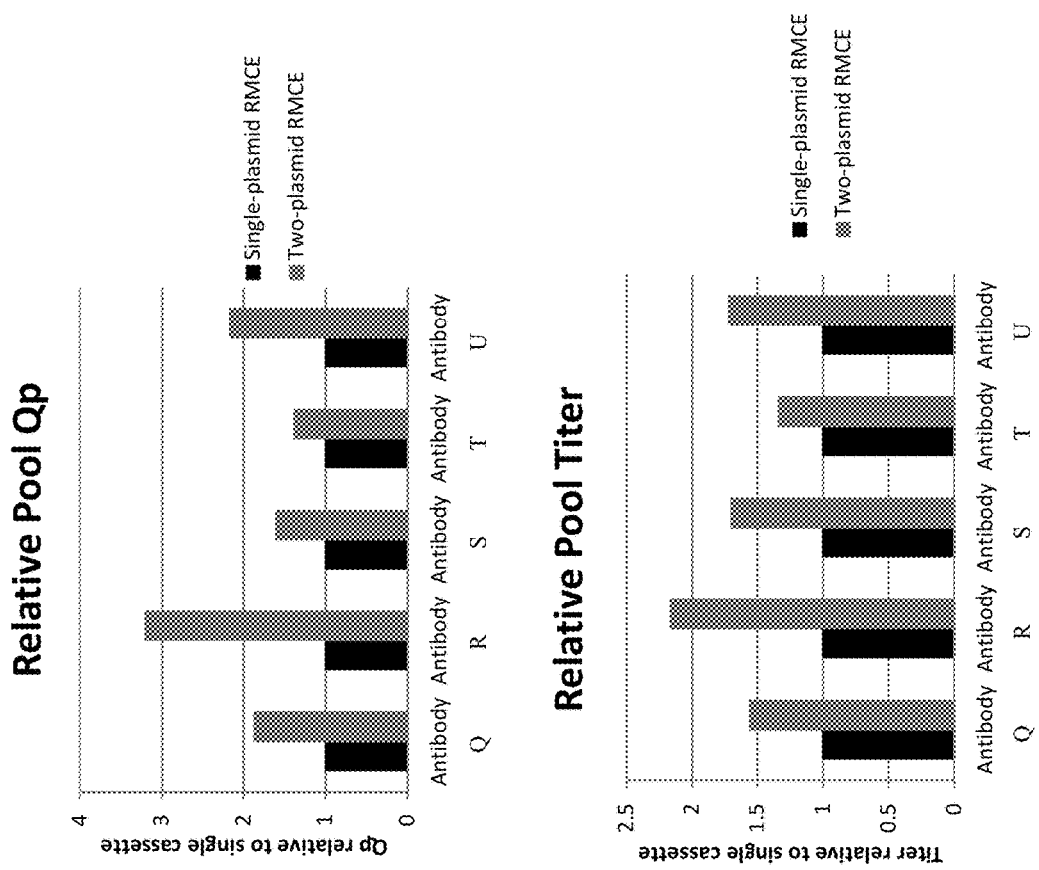
FIG. 5 depicts the results of using either single-vector or two-vector RMCE in connection with the expression of Antibodies D, E, F, G, and J. FACS, genomic PCR, and gene copy analysis were assessed to confirm both plasmid cassettes were targeted correctly to the TI site. In two-plasmid RMCEs, more total HC and LC copies were targeted to the TI site as compared to single plasmid RMCE.

To test the robustness of the two-plasmid RMCE approach, the original GFP landing pad was replaced by the new GFP landing pad with three RRS sites using a TI host identified previously, Host 4. A more severe viability dip and longer recovery time were observed for the two-plasmid RMCE compared to the single-plasmid RMCE, consistent with lower initial RMCE efficiency for the two-plasmid RMCE. Once the pools recovered, FACS, genomic PCR and gene copy analysis were assessed to confirm both plasmid cassettes were targeted correctly to the TI site. In total, five standard antibodies (Q, R, S, T, and U) were tested for productivity using both single-plasmid RMCE and two-plasmid RMCE (FIG. 5). In two-plasmid RMCEs, more total HC and LC copies were targeted to the TI site compared to single plasmid RMCE. In all five cases, productivities of the two-plasmid TI transfection pools were consistently higher, up to 200% increase compared to those of the single plasmid pools. The increase in titer in two-plasmid RMCE was mainly attributed to specific productivity, which saw its level improve by as much as 300% compared to that of single-plasmid RMCE.

Figure 6:
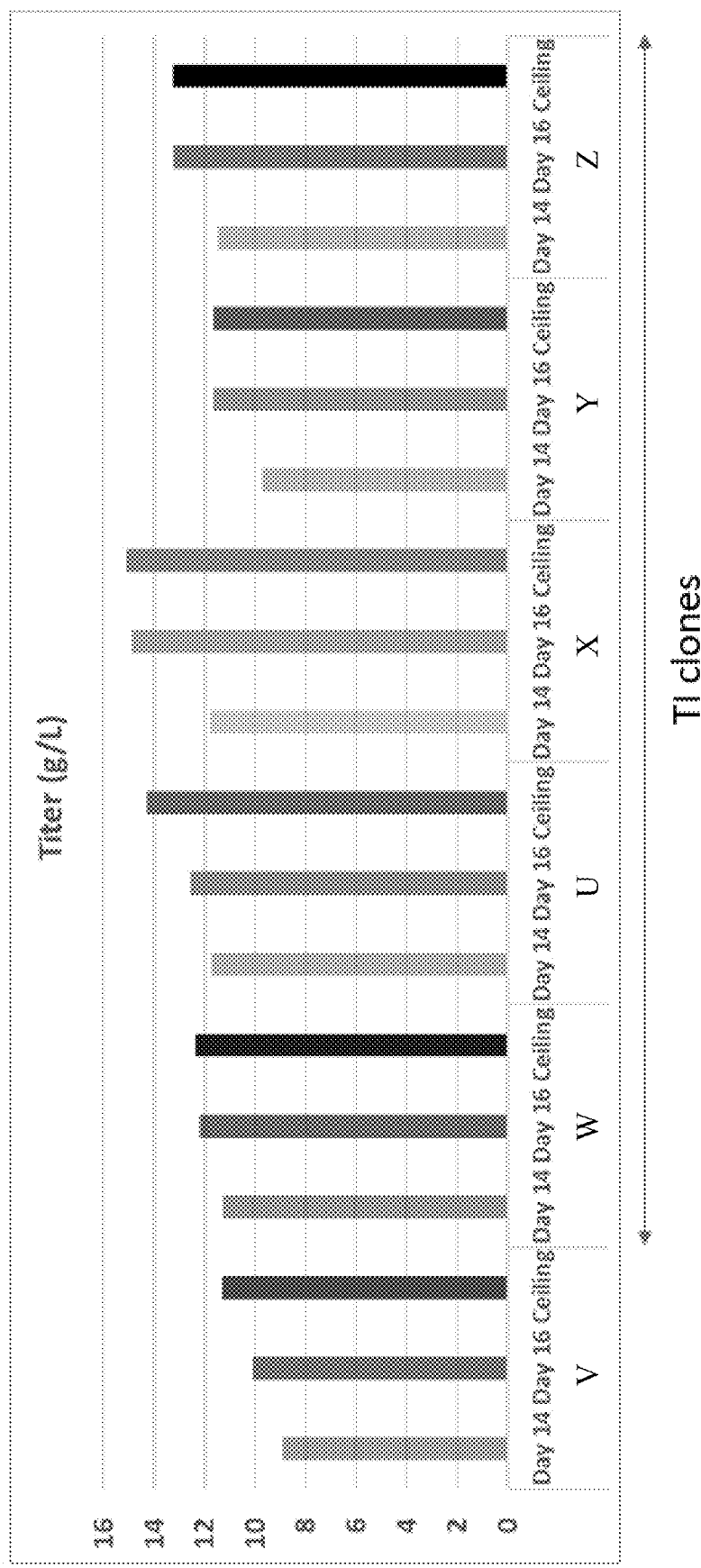
FIG. 6 depicts the titers of six molecules.

Well-characterized TI hosts, e.g., Host 4, were further assessed in a different cell culture platform for their ability to achieve high titers of 5 different antibodies. FIG. 6 shows the productivity of these antibodies by these TI hosts. Productivity higher of 10 g/L was achieved at Day 14 and higher than 12 g/L at Day 16 for most of the antibodies.

Figure 7:
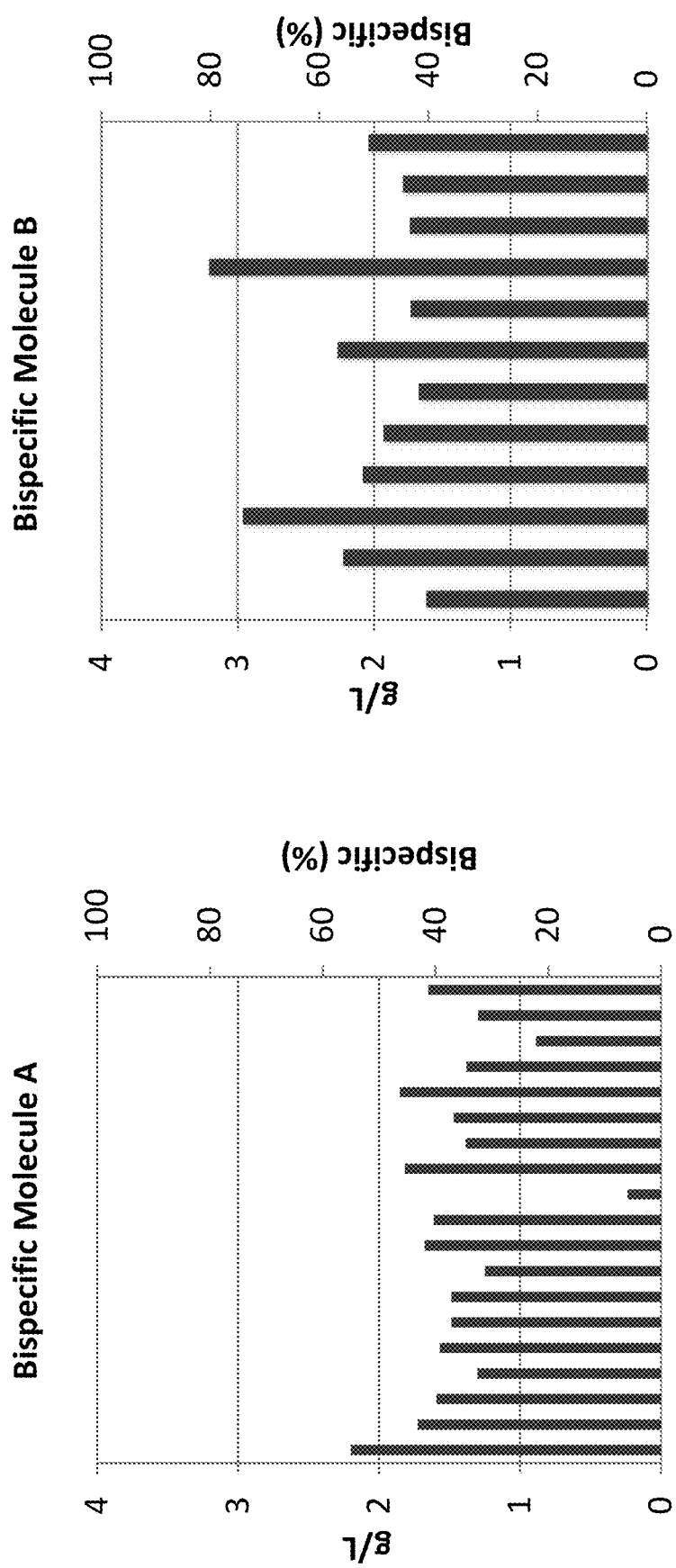
FIG. 7 depicts the results of using two-vector RMCE to express complex mAb formats. Two bispecific molecules, each requiring four different chains (two HCs and two LCs), were assay for production and % bispecific formation. In both cases, cell lines were developed exhibiting >1.5 g/L with >80% bispecific content.

To assess using two-plasmid RMCE to express complex mAb formats, two bispecific molecules that required four different chains (two HCs and two LCs) to be expressed in the same cell for bispecific assembly were tested. By enabling two separate expression plasmids to be targeted simultaneously, plasmid configuration of the different chains can be manipulated to achieve optimal chain ratios for balanced expression. In both cases, cell lines derived from Host 4 were developed having >1.5 g/L with >80% bispecific content (FIG. 7) using two-plasmid RMCE.

Figure 8:
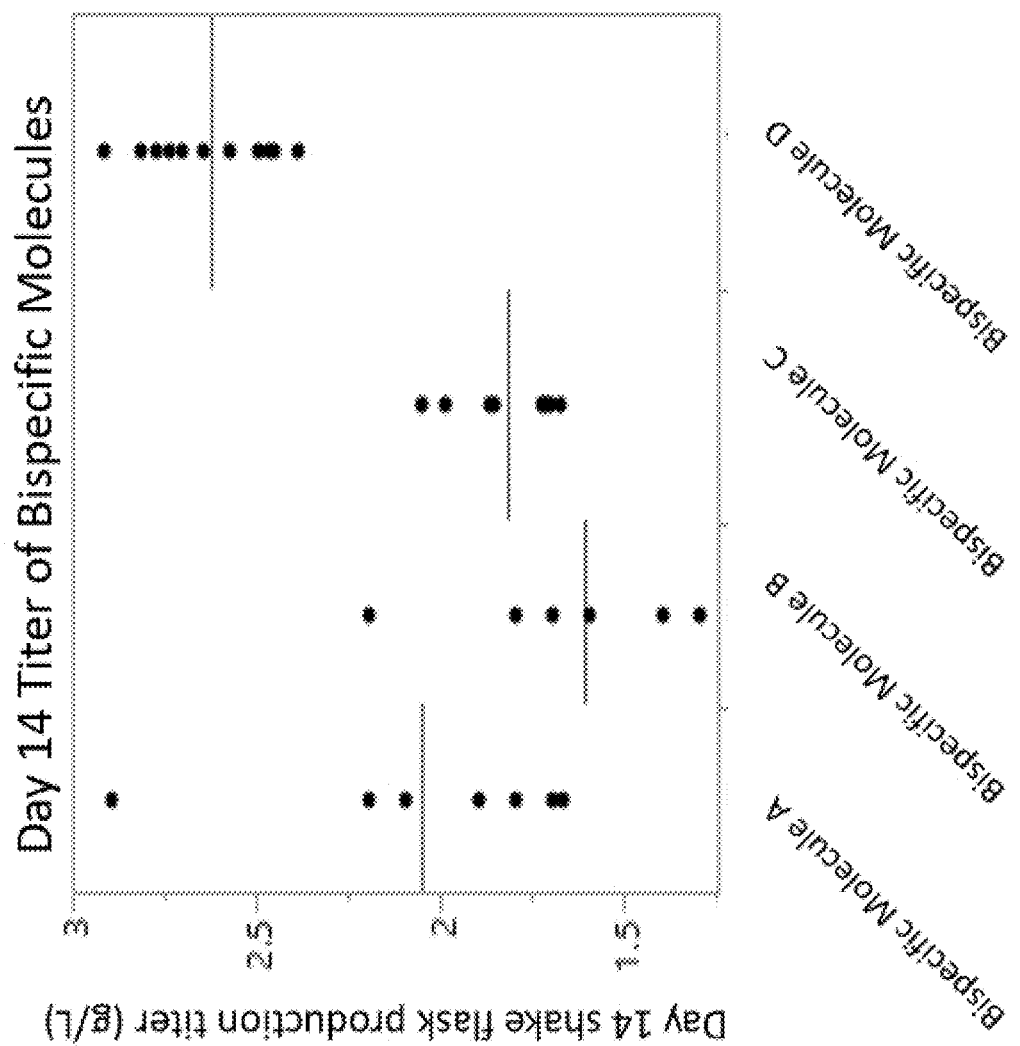
FIG. 8 depicts the day 14 titers of four bispecific molecules.

The day 14 titer of four bispecific molecules that required four different chains (two HCs and two LCs) to be expressed in the same cell for bispecific assembly was also evaluated. All the cell lines, which were derived from Host 4, were developed having >1.5 g/L titer (FIG. 8) with >80% bispecific content using two-plasmid RMCE.

Example 3: Expression and Growth Analysis of RTI Cell Lines Expressing mAb-I (Difficult-to-Express) Vs. mAb-II (Average-Expressing) Antibody Molecules A difficult-to-express molecule is defined as such when after several CLD attempts, all the generated cell lines achieve titers that are below what is usually expected from a standard CLD platform process. For one previously identified difficult-to-express antibody (mAb-I), for example, more than 120 cell lines from 4 separate CLD attempts were evaluated in the fed-batch production cultures. Yet, the highest mAb-I expressing cell lines could only achieve 50% of the typical titer when compared to an average antibody molecule (mAb-II), for which only 24 cell lines were screened (FIG. 9A table). Unfortunately, tracing the underlying cause(s) that might make a molecule difficult-to-express in a random integration system is very difficult, mainly due to the differences in transgene copy numbers and gene integration sites between different cell lines.

Figure 9B:
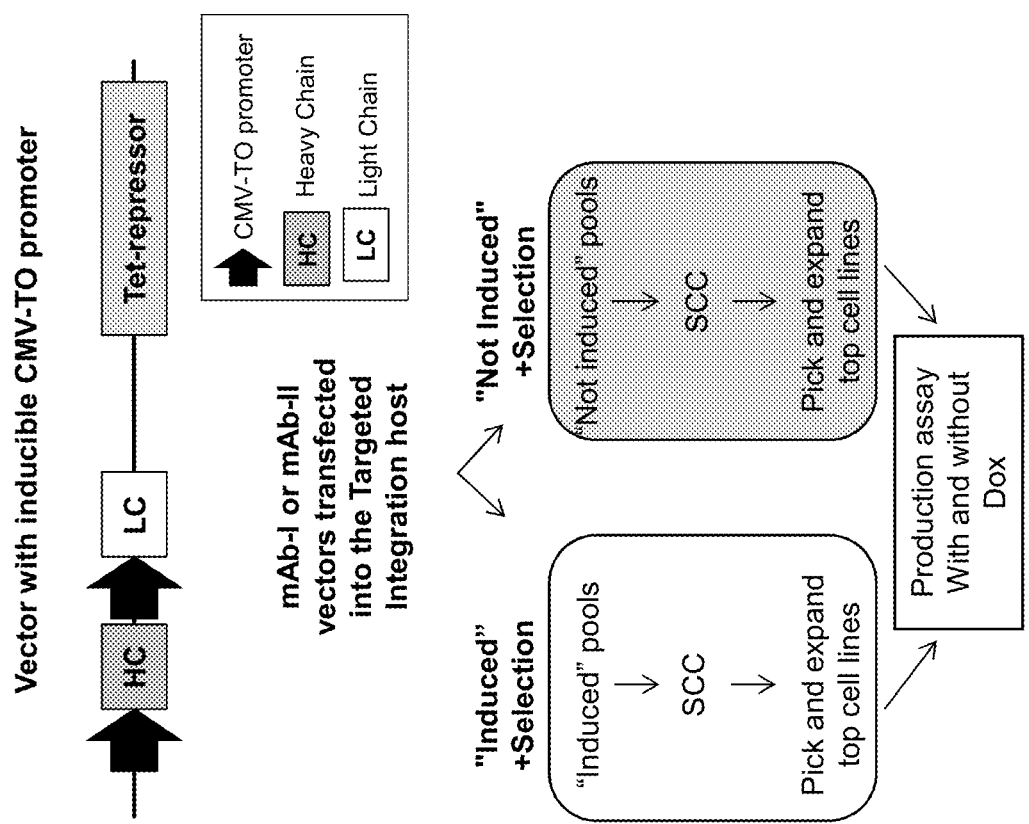
FIG. 9 A and B depict the generation of cell lines expressing mAb-I or mAb-II in the RTI system. Histological results for cell line development are depicted in FIG. 9A and a schematic of a RTI cell line development (CLD) process is depicted in FIG. 9B.

To identify the underlying factor(s) that made mAb-I difficult-to-express, CLD was initiated for both mAb-I and mAb-II molecules using a RTI system. Both HC and LC constructs were cloned into an expression vector under the inducible CMV-TO promoter control and these vectors were transfected into a TI host in order to increase the possibility of isolating cell lines with similar levels of transgene transcription. The overall schematic of the RTI CLD approach for mAb-I and mAb-II is depicted in FIG. 9B. Transfected cell lines were subjected to selection using two separate conditions, under which cell lines were either 1) derived in the presence of Dox (Induced), or 2) in the absence Dox (Not-Induced), throughout the CLD process. Cell lines derived in the absence of Dox were only temporarily induced to be ranked based on seed train titer or during production assays where indicated. This enabled the evaluation of the role of antibody expression (expression pressure) during the selection process (FIG. 9B).

Figure 10A:
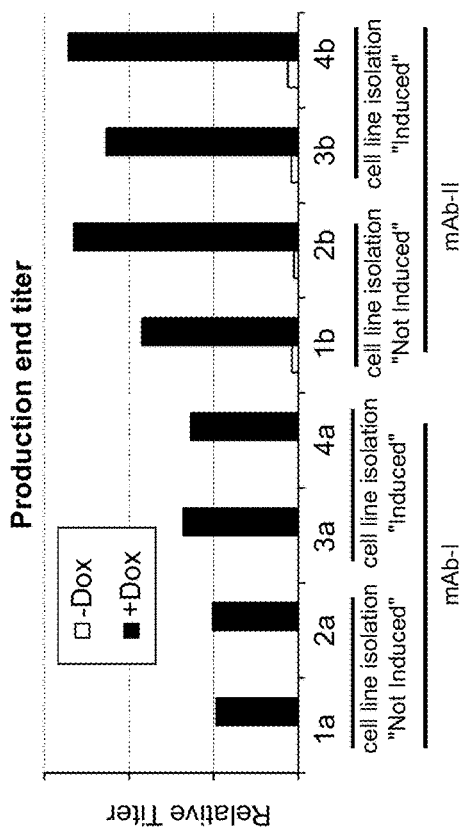
FIGS. 10 A to C depict the titer and specific productivity results of cell lines expressing mAb-I or mAb-II. Production end titer is depicted in FIG. 10A, production end IVCC is depicted in FIG. 10B and production end specific productivity is depicted in FIG. 10C.
Figure 10B:
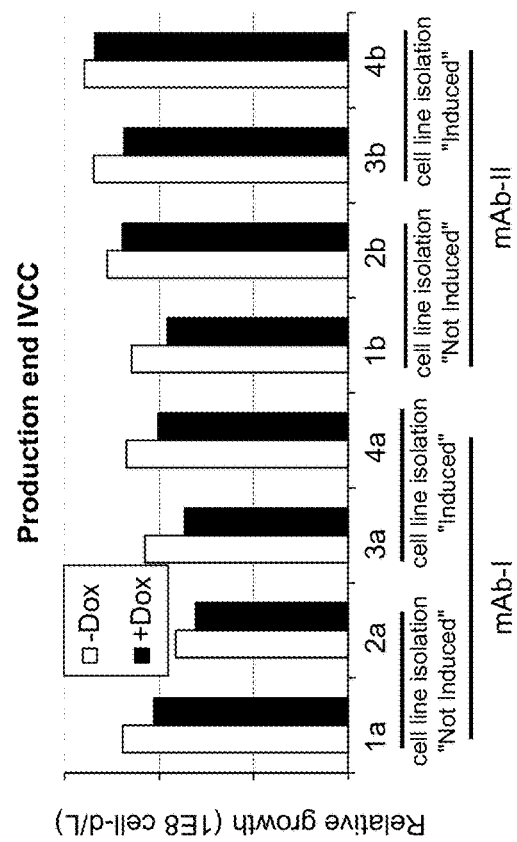
Figure 10C:
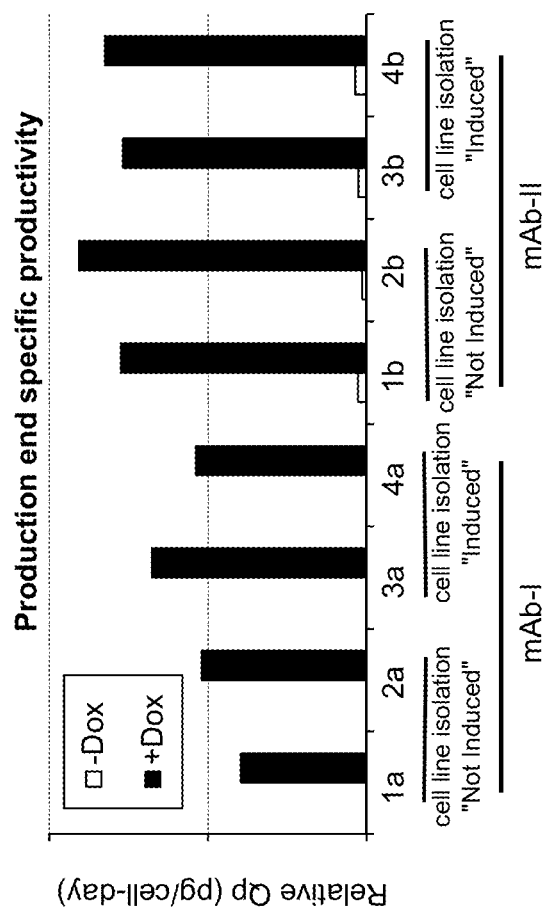

Production assays were performed using two representative mAb-I and mAb-II cell lines, derived from Host 7, from both "Induced" and "Not-Induced" seed-train arms in the presence or absence of doxycycline. The latter was used to evaluate promoter leakiness and basal antibody production levels in the absence of induction. A rather tight regulation of antibody expression in the absence of doxycycline was observed, suggesting that the regulated expression system functioned effectively in these cell lines (FIGS. 10A and 10C). Growth (FIG. 10B) profiles of all cell lines in the presence or absence of doxycycline were comparable, although in the absence of doxycycline growth profiles appeared slightly better. Cell lines that were derived under "Induced" or "Not-Induced" seed-train conditions displayed relatively comparable titers and specific productivities during production (FIGS. 10A and 10C, compare cell lines 1&2 to 3&4 for mAb-I or mAb-II), indicating that constitutive antibody expression during selection did not play a significant role in isolation of high titer cell lines (FIG. 10). In addition, similar to the RI CLD attempts, titer and specific productivity of mAb-I RTI cell lines were still 50% lower than mAb-II RTI cell lines (FIGS. 10A and 10C). This observation ruled out chronic toxicity as a culprit for low expression of mAb-I, since both "Induced" and "Not-Induced" RTI cultures of mAb-I similarly displayed lower titers compared to the mAb-II control cell lines.

Figure 11A:
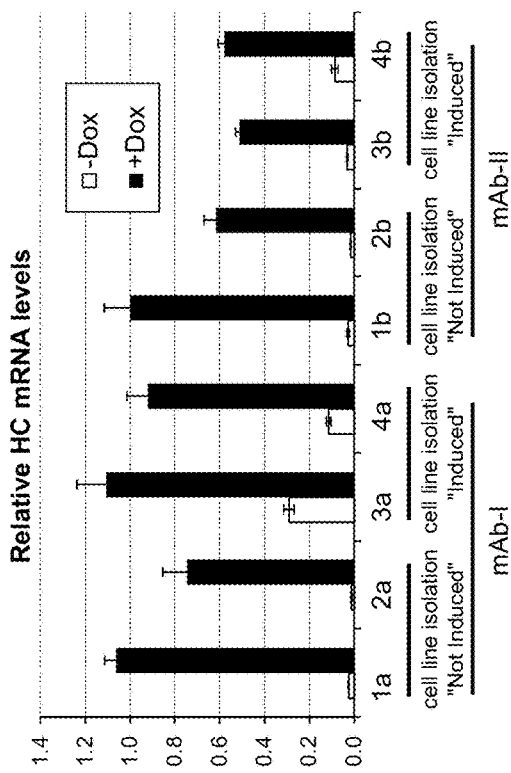
FIGS. 11 A and B depict the expression levels of HC and LC mRNA of mAb-I and mAb-II expressing cell lines. The expression levels of HC mRNA are depicted in FIG. 11A and the expression levels of HL mRNA are depicted in FIG. 11B.
Figure 11B:
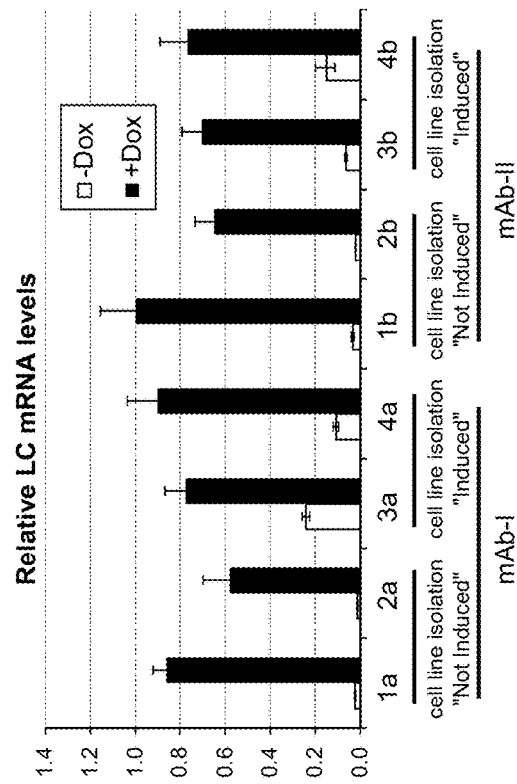

Example 4: Lower Antibody Expression in mAb-I Cell Lines was not Due to Lower Transcription To analyze lower antibody expression observed in mAb-I expressing cell lines, qRT-PCR experiments were performed to measure mRNA levels of antibody HC and LC in the RTI cell lines expressing mAb-I or mAb-II, under doxycycline induced and uninduced conditions. In the absence of Dox, mAb-I or mAb-II cell lines expressed little or no HC or LC mRNA, indicative of a relatively tight transcriptional regulation by the inducible promoter (FIG. 11). In the presence of Dox, antibody HC and LC transcription levels for mAb-I expressing cell lines were comparable to or higher than those of mAb-II expressing cell lines (FIGS. 11A and 11B). These results confirmed that a reduced level of transgene transcription was not the reason for low antibody expression in mAb-I expressing cell lines. Additionally, absence or presence of doxycycline in the seed-train cultures during CLD process had no impact on transgene transcription rates, since cell lines isolated under "Induced" or "Not-Induced" conditions had comparable HC or LC mRNA levels (FIGS. 11A and 11B).

Figure 12A:
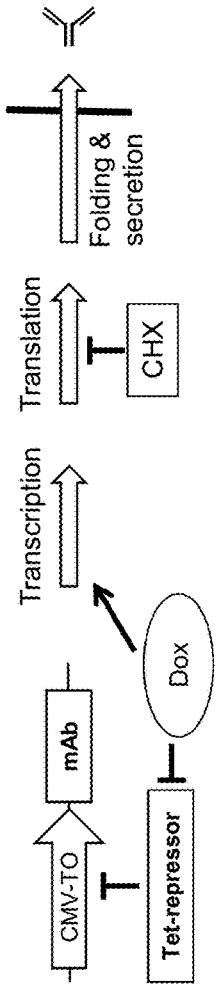
FIGS. 12 A to D depict the intracellular levels of HC, HL and BiP molecules in cell lines expressing mAb-I or mAb-II. A schematic of cycloheximide and Dox effects on an RTI system is depicted in FIG. 12A. The intracellular levels of HC, LC and BiP as well as the HC and LC levels in the supernatants of cell lines expressing mAb-A or mAb-B are depicted in FIG. 12B. The intracellular levels of HC, LC and BiP of cell lines expressing mAb-I or mAb-II after overnight CHX treatment are depicted in FIG. 12C. The intracellular levels of HC, LC and BiP of cell lines expressing mAb-I or mAb-II after doxycycline removal from culture media are depicted in FIG. 12D.
Figure 12B:
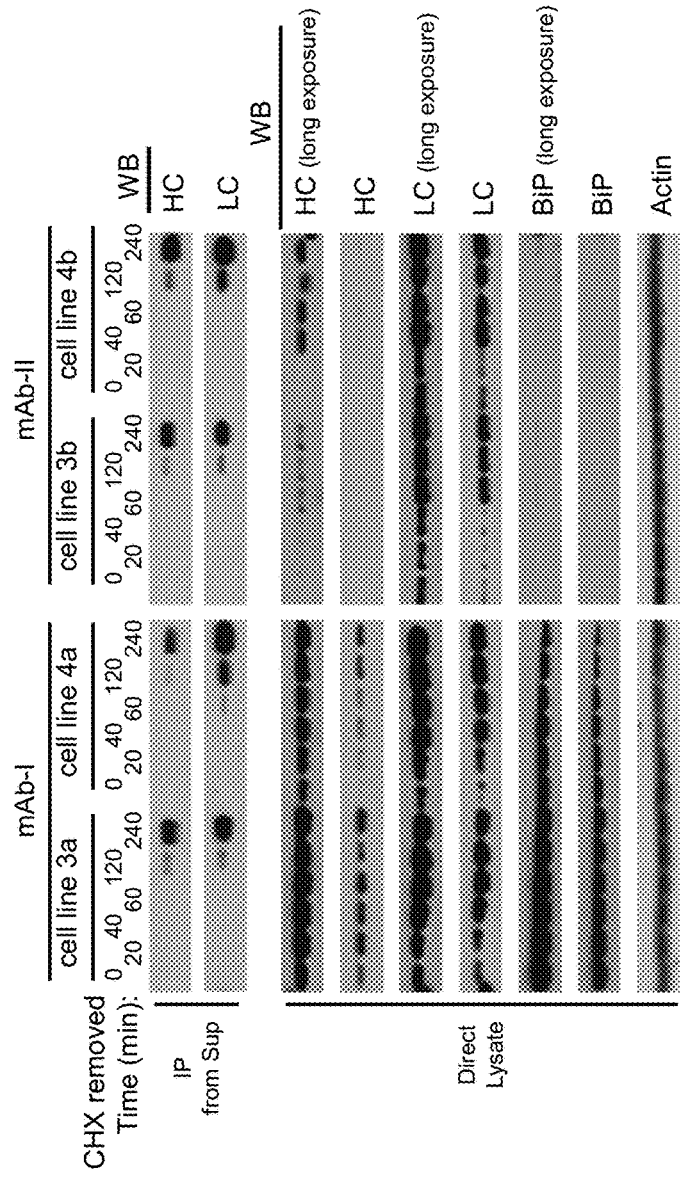

Example 5: Induction of mAb-I Expression Resulted in Reversible Accumulation of Intracellular BiP and Delayed Antibody HC Degradation To identify the underlying factors affecting mAb-I expression, Dox induction along with cycloheximide (CHX) treatment and removal was used to investigate antibody secretion, folding and degradation. For these experiments, "Induced" cultures were treated with CHX to stop protein synthesis and after 5 hours, cells were washed and resuspended into media containing only Dox (no CHX), to resume protein synthesis (FIG. 12A). HC or LC were not detected in the supernatants of these cultures for approximately 60 min post CHX removal and a gradual increase in antibody secretion was only detected after 120 min and at similar rates (FIG. 12B, upper panels). This suggested that secretion of properly folded and assembled antibody molecules were comparable between mAb-I and mAb-II cell lines post CHX removal. The intracellular levels of antibody LC were also fairly comparable between mAb-I and mAb-II expressing cell lines (FIG. 12B, LC panels). However, significantly higher levels of intracellular antibody HC in mAb-I expressing cell lines were detected compared to mAb-II expressing lines, even after 5 hours of CHX treatment (FIG. 12B, HC panels). This implicated a delay or problem in degradation and clearance of unfolded or misfolded antibody HC in mAb-I expressing cell lines. Interestingly, very high levels of intracellular BiP in the mAb-I were detected relative to the mAb-II cell lines before and after CHX treatment (FIG. 12B, lower panels, BiP). BiP as a chaperone has been implicated in the unfolded protein response (UPR) as well as antibody HC or LC folding, and its presence in the seed train culture could be an indicator of ER associated cellular stress.

Figures 12C, 12D:
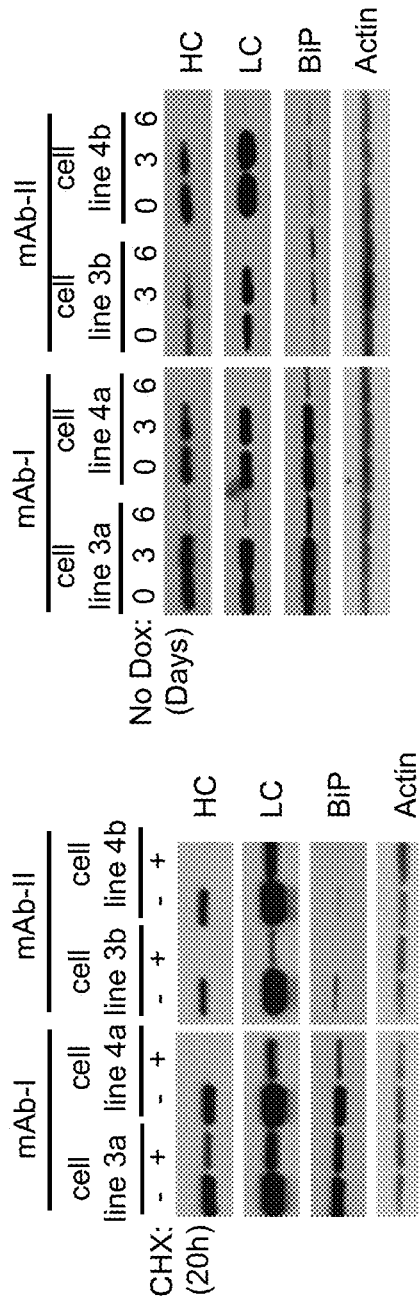

To further investigate the correlation between mAb-I expression and intracellular BiP accumulation, "Induced" seed train cultures were treated with or without CHX overnight in media containing doxycycline and evaluated the intracellular HC, LC and BiP levels in these samples. In the absence of CHX treatment, the basal levels of intracellular antibody HC molecules were higher in mAb-I relative to mAb-II cell lines, while levels of intracellular LC were comparable between all sample sets. BiP levels on the other hand were considerably higher in mAb-I relative to mAb-II expressing cell lines (FIG. 12C, −CHX samples). Overnight treatment of these cultures with CHX resulted in a reduction in levels of HC and LC in all cell lines, along with a concurrent reduction in BiP levels specifically in mAb-I expressing cell lines (FIG. 12C, +CHX samples). This was in agreement with previous findings (FIG. 12B). Since cycloheximide inhibits synthesis of all eukaryotic proteins indiscriminately, the higher BiP levels in mAb-I cell lines could not be directly linked to accumulation of antibody HC or LC subunits.

However, the regulated expression system offered the ability to directly test the link between intracellular BiP and antibody HC or LC levels. To that end doxycycline was removed from the media for 6 days, to specifically turn off antibody expression without affecting expression of other endogenous proteins, and monitored intracellular HC, LC, and BiP levels. A direct and specific link between antibody (HC and LC) expression and accumulation of intracellular BiP for mAb-I cell lines was observed, while expression of mAb-II showed no effects on intracellular BiP levels (FIG. 12D).

Figures 13A, 13B:
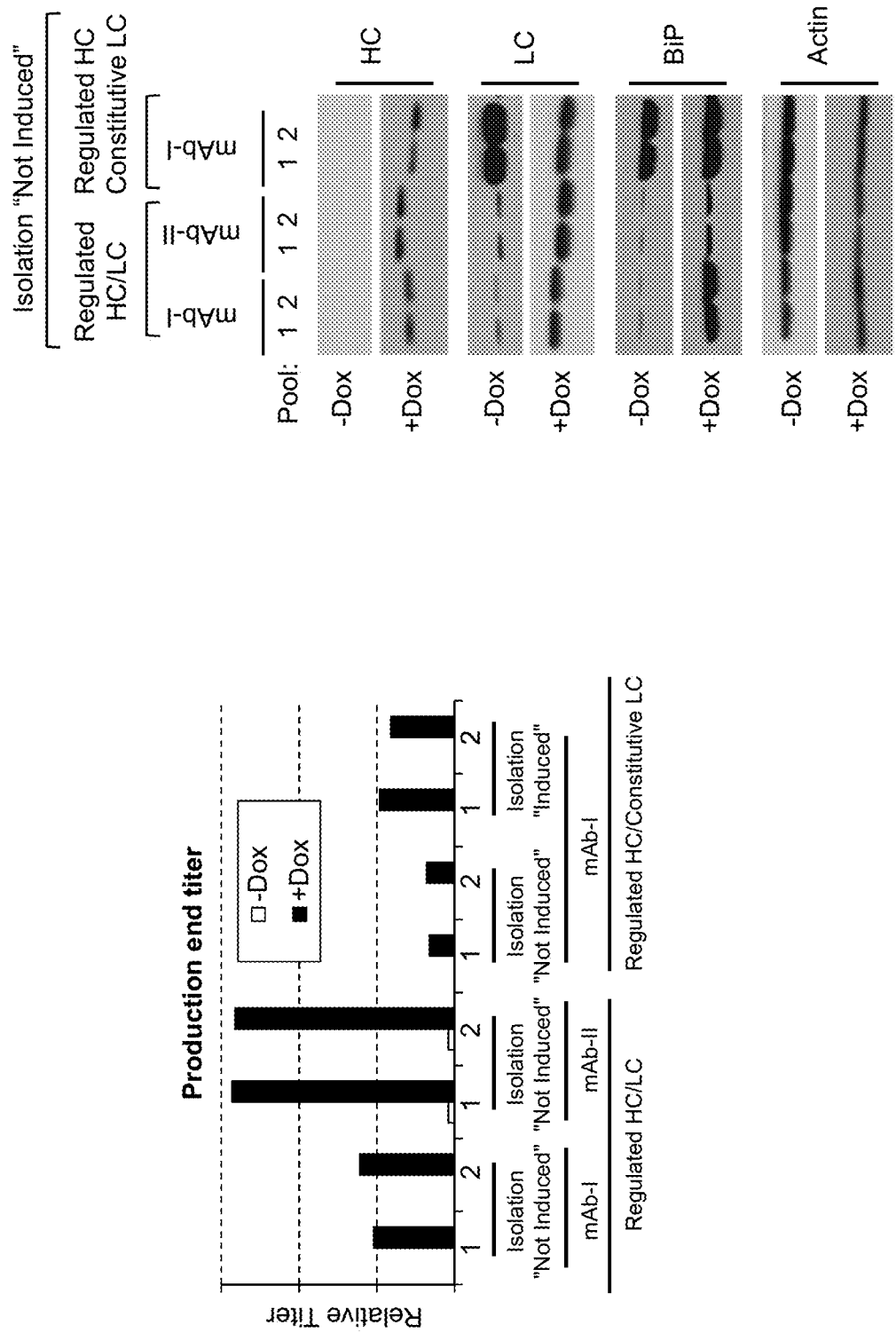
FIGS. 13 A to D depict the correlation between the intracellular accumulation of BiP and mAb-I LC expression. The production end titer is depicted in FIG. 13A and the accumulation of HC, LC and BiP is depicted in FIG. 13B. A schematic representation of chain-swap experiments is depicted in FIG. 13C. The intracellular levels of HC, LC and BiP of RTI pools expressing mAb-I, mAb-II, or chain-swapped versions of these molecules are depicted in FIG. 13D.

Example 6: Although mAb-I LC Expression Triggered Intracellular BiP Accumulation, mAb-I HC Also Distinctly Contributed to Low Expression of this Antibody To determine whether mAb-I LC played a role in accumulation of intracellular BiP, a construct was generated that expressed mAb-I HC under a regulated promoter while LC was expressed constitutively. This construct along with constructs expressing regulated HC/LC of mAb-I or mAb-II (controls) were transfected into the CHO cells and two separate pools from each transfection were derived. Pool titers were evaluated in production culture (FIG. 13A) while seed train cultures were evaluated by Western blot analysis (FIG. 13B) in the presence and absence of doxycycline. During production assay, each pool was induced with Dox or remained uninduced. Uninduced pools expressed very little antibody during production, indicative of a tight expression regulation (FIG. 13A, -Dox). Analysis of Dox induced cultures during production revealed that the regulated-HC/constitutive-LC mAb-I expressing pools derived from "Not-induced" seed train cultures had considerably lower titers relative to the regulated HC/LC mAb-I pools and regulated-HC/constitutive-LC mAb-I pools that were "Induced" during seed train (FIG. 13A). Western blot analysis of "Not Induced" cultures showed that under all conditions antibody HC was expressed only when Dox was added to the media. In addition, constitutive expression of mAb-I LC alone, without the mAb-I HC, triggered accumulation of intracellular BiP (FIG. 13B). These results implied a direct connection between expression of mAb-I LC subunit and accumulation of the intracellular BiP. When constitutively expressed in the absence of HC, the LC molecules of mAb-I likely form unfolded aggregates within the ER that interact with BiP chaperone, triggering an increase in intracellular levels of BiP in these cells. Expression of mAb-I HC during production phase could have further burdened these cells, increasing the demand for intracellular BiP to accommodate folding of both HC and LC molecules, resulting in inefficient antibody assembly, folding and secretion efficiency (FIG. 13A).

Figure 13C:
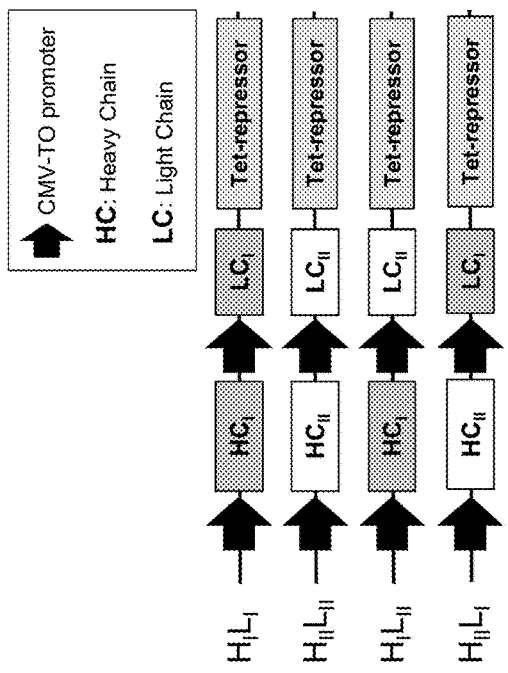
Figure 13D:
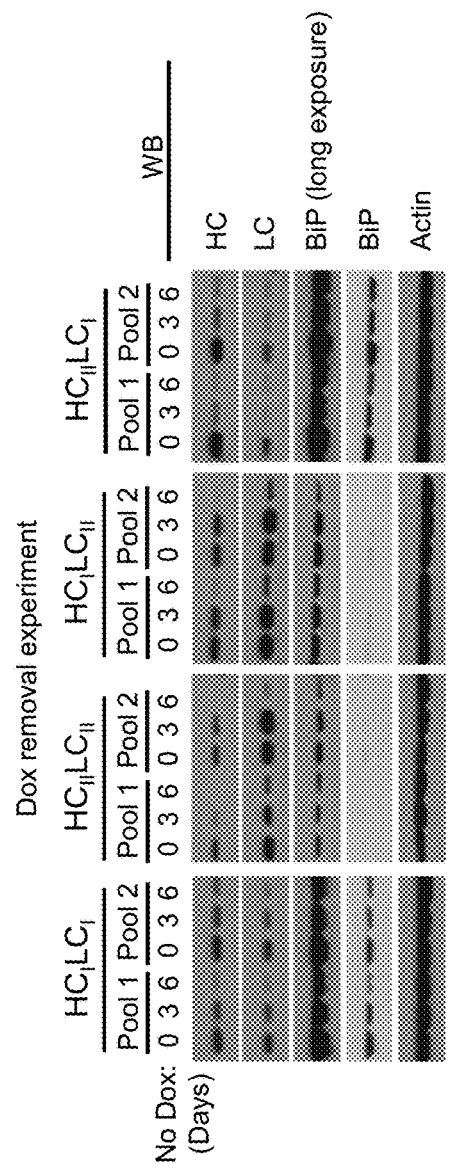

While these findings pointed to a connection between mAb-I LC expression and cellular ER stress, as indicated by accumulation of intracellular BiP, a direct connection between expression of mAb-I LC and low titers of mAb-I cell lines needed to be established. To that end, antibody molecules were generated where mAb-I and mAb-II heavy and light chains were swapped to generate $HC_ILC_I$, $HC_ILC_{II}$, $HC_{II}LC_{II}$, and $HC_{II}LC_I$ antibody combinations. $HC_ILC_{II}$ construct expressed an antibody with mAb-I HC and mAb-II LC, while $HC_{II}LC_I$ construct expressed an antibody with mAb-II HC and mAb-I LC. Antibody HC and LC expression for all these constructs were under the control of CMV-TO promoter in the RTI vector system (FIG. 13C). These constructs were then transfected into our CHO TI host cells and two separate RTI pools, for each construct, were generated and expression of mAb-I, or mAb-II, or the hybrid versions of these antibodies were tested. As previously noticed (FIG. 13B), a clear and direct correlation between mAb-I LC expression and accumulation of intracellular BiP was observed (FIG. 13D, LC and BiP blots). Interestingly, intracellular BiP was also accumulated in a less intense but yet noticeable manner in pools expressing $HC_ILC_{II}$ hybrid antibody compared to $HC_{II}LC_I$, hinting towards some levels of ER stress in these pools, likely due to expression of $HC_I$ (FIG. 13D, compare long exposure BiP levels in $HC_{II}LC_{II}$ and $HC_ILC_I$ samples). Turning off antibody expression via Dox removal resulted in reduction of intracellular BiP levels in all RTI pools except for mAb-II ($HC_BLC_B$) pool, where the initial levels of both intracellular HC and BiP were considerably lower even prior to Dox removal (FIG. 13D, compare HC and BiP levels at Day 0 in $HC_{II}LC_{II}$ pools to other pools).

Figure 14A:
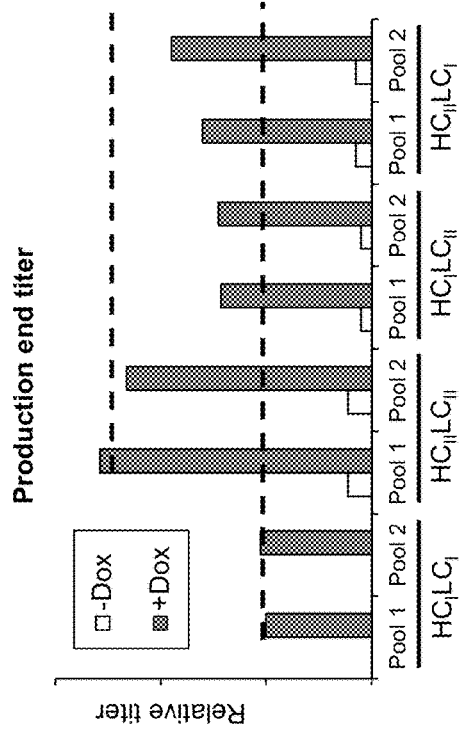
FIGS. 14 A to C depict the contribution of mAb-A HC and HL to the pool expression of this molecule. Production end titer is depicted in FIG. 14A, production end IVCC is depicted in FIG. 13B and production end specific productivity is depicted in FIG. 14C.
Figure 14B:
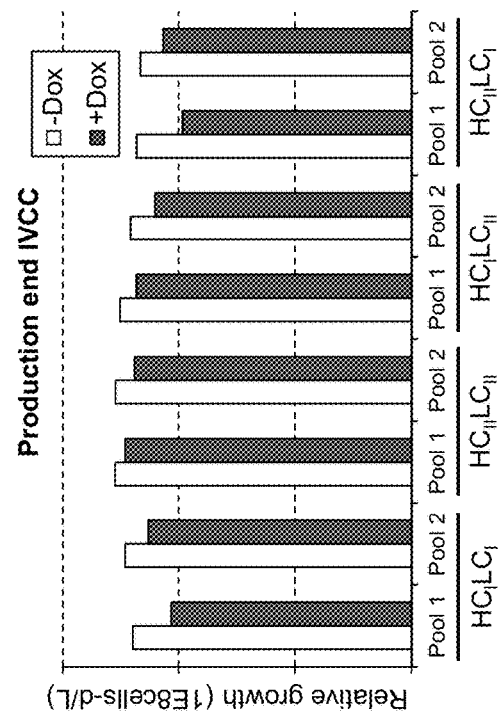
Figure 14C:
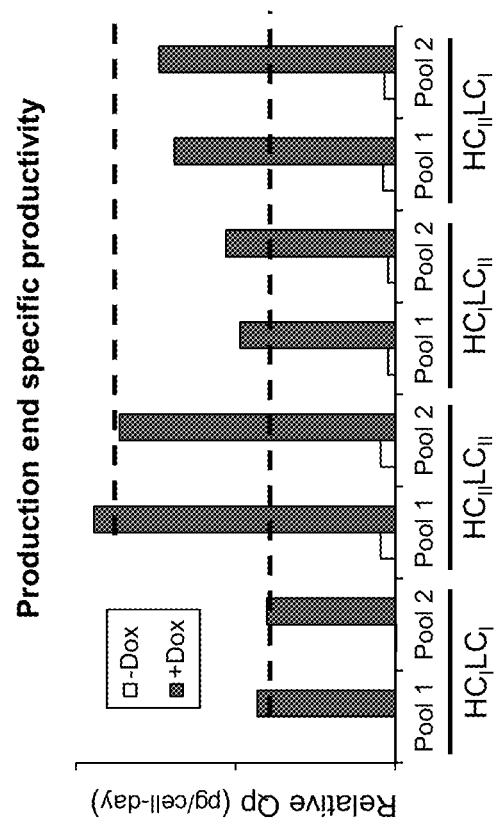

To evaluate the role of mAb-I HC and LC on overall antibody expression, the $HC_ILC_I$, $HC_{II}LC_{II}$, $HC_ILC_{II}$, and $HC_{II}LC_I$ RTI pools were evaluated in production assays. In the absence of doxycycline, all the RTI pools expressed little antibody, exhibiting a tight regulation of antibody expression (FIG. 14A, -Dox). Growth rates for all the RTI pools were similar, with the induced cultures having slightly lower growth rates relative to the uninduced cultures (FIG. 14B). As previously observed, the mAb-I and mAb-II RTI pools had the lowest and highest titers and specific productivities, respectively (FIGS. 14A and 14C). Interestingly, both $HC_{II}LC_I$ and $HC_ILC_{II}$ RTI pools displayed titers and specific productivities that were higher than $HC_ILC_I$ but lower than $HC_{II}LC_{II}$ RTI pools (FIGS. 14A and 14C). These results indicated that both mAb-I HC and LC subunits individually contributed to the lower expression of this antibody relative to the mAb-II. Contrary to our expectations, hybrid RTI pools that expressed $LC_I$ subunit had slightly higher titers and specific productivities compared to the pools expressing HC subunit (FIGS. 14A and 14C). This indicated that mAb-I HC played a slightly more significant role in the lower expression of this antibody relative to the LC subunit. It was the use of antibody chain swap approach in combination with the RTI system that revealed the negative effects associated with the expression of mAb-I HC subunit, even when a clear indicator of biological stress (such as intracellular BiP accumulation) could not be identified.

Figure 15A:
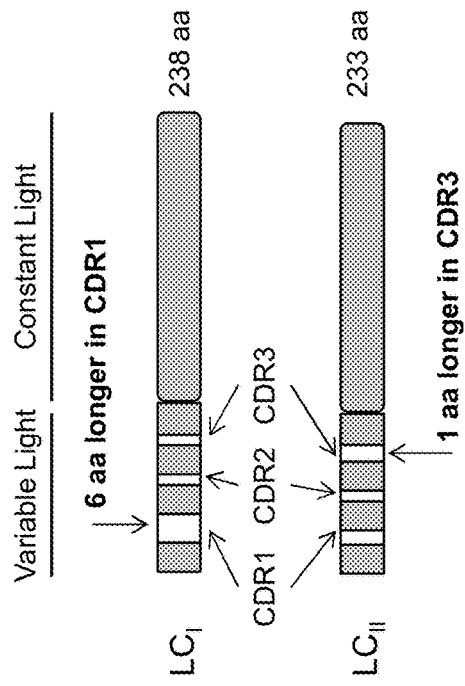
FIGS. 15 A to B depict CDR regions of LC and HC that may contribute to poor expression. A schematic representation of the mAb-I and mAb-II LC subunits is depicted in FIG. 15A. A schematic representation of mAb-I and mAb-II HC regions is depicted in FIG. 15B.
Figure 15B:
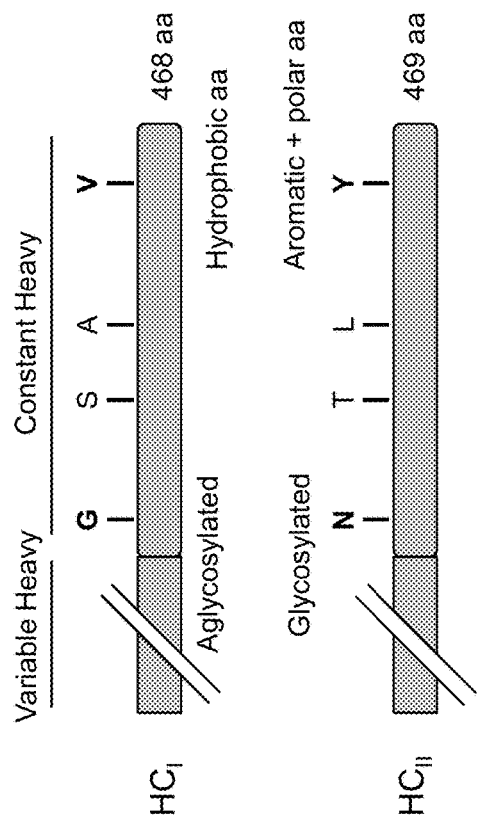
Figures 16A, 16B:
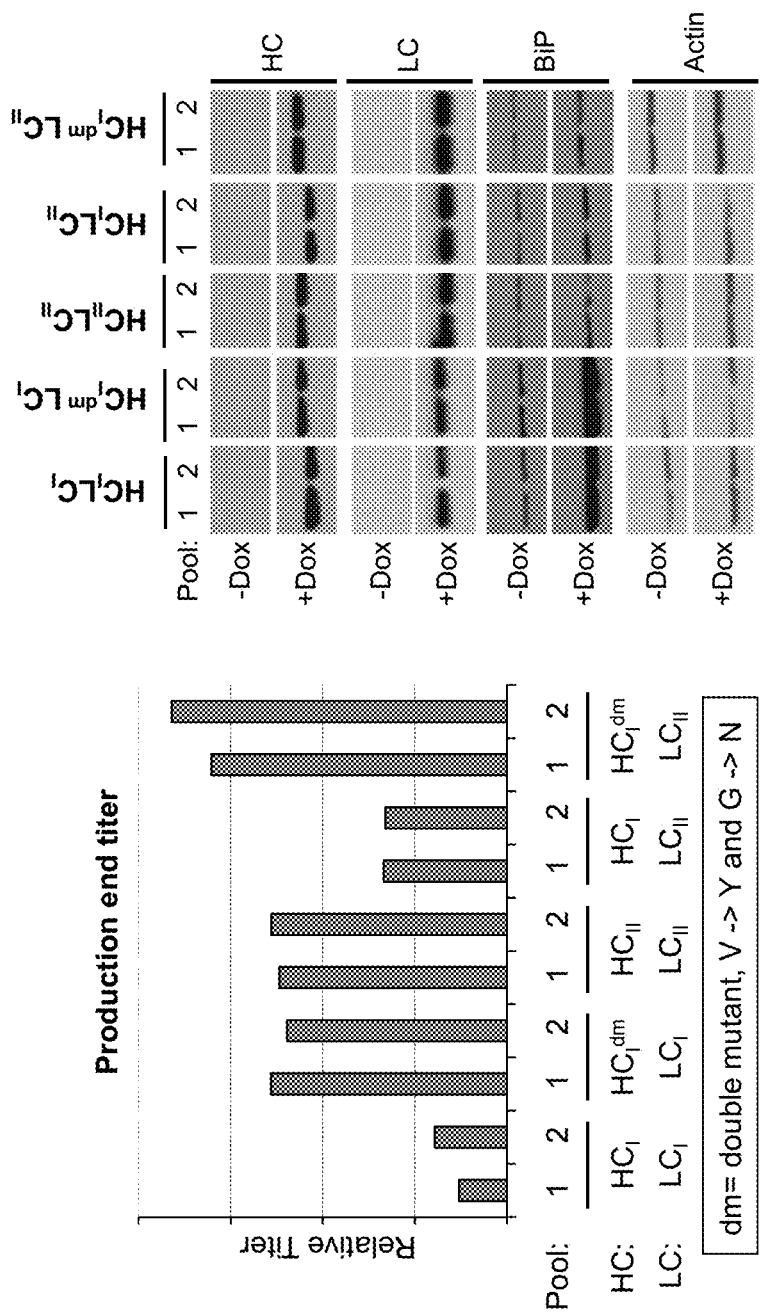
FIGS. 16 A to C depict the results of using two point mutations in HC constant region in connection with the expression of HCA. The production end titer of various chain swaps between mAb-I and mAb-II HC and LC subunits is depicted in FIG. 16A. The intracellular levels of HC, LC and BiP of various RTI pools are depicted in FIG. 16B. A schematic of RTI system utilization as a diagnostic tool for low protein expression is depicted in FIG. 16C.
Figure 16C:
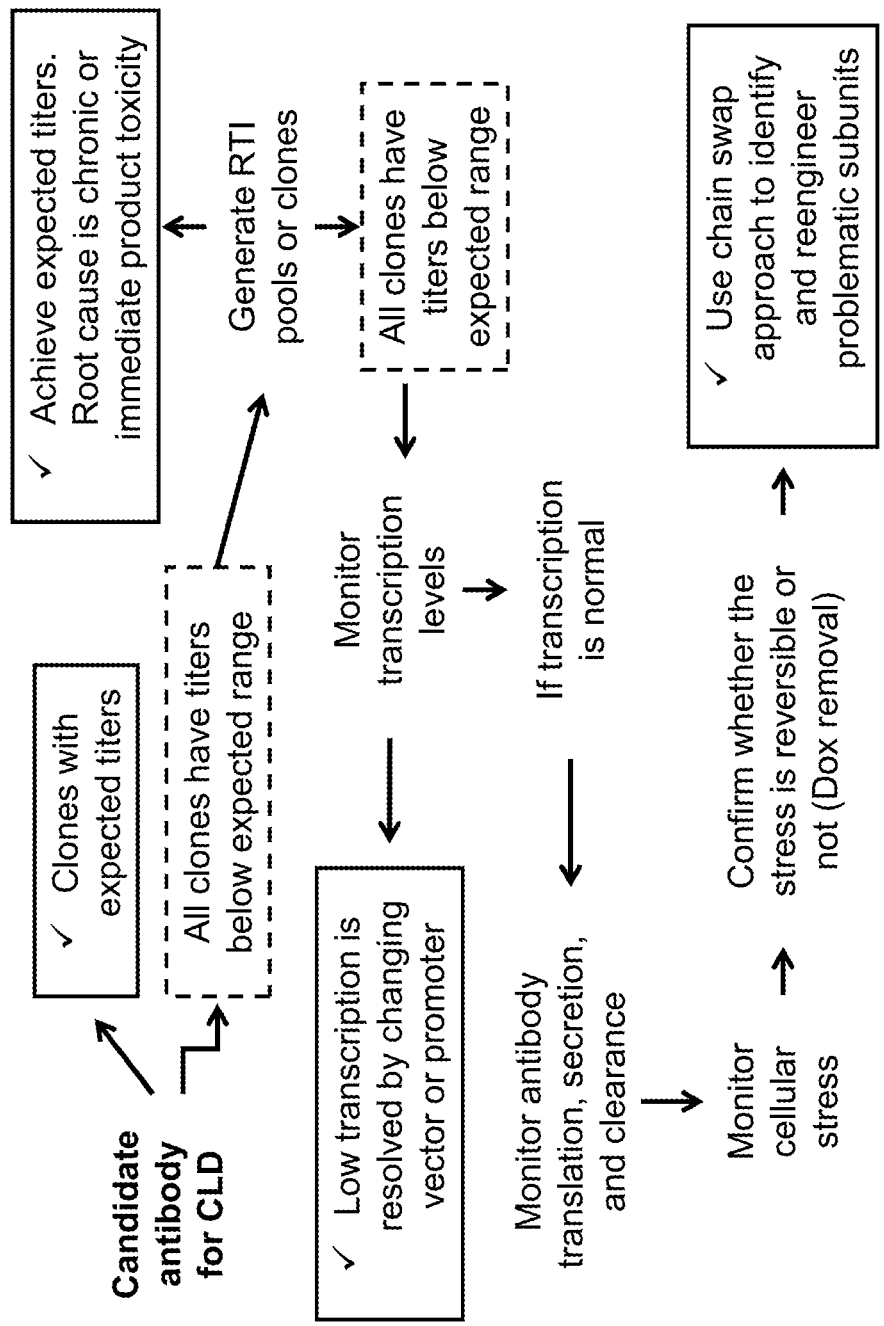

Example 7: Amino Acid Sequence Differences Between mAb-I and mAb-II HC and LC Subunits To assess whether certain amino acids residues might contribute to the problematic expression of mAb-I HC and LC, the amino acid sequences of mAb-I and mAb-II LC (FIG. 15A) and HC (FIG. 15B) subunits were aligned. The amino acid composition for all CDR regions of mAb-I and mAb-II HC and LC molecules were different from each other, as they were developed to target different antigens. In the LC subunit, there are no amino acid sequence differences between mAb-I and mAb-II molecules for the rest of the variable and all of the constant regions. The CDR1 segment of $LC_I$ is 6 amino acids longer than $LC_{II}$, while CDR3 segment of $LC_{II}$ is one amino acid longer than $LC_I$ (FIG. 15A). As for the antibody HC subunit, excluding the CDR segments, the rest of the variable and constant regions of $HC_I$ and $HC_{II}$ are identical with the exception of 4 amino acids residues (FIG. 15B). Two of these amino acid changes were fairly conservative (T→S and L→A) and hence unlikely to contribute to the low expression of $HC_I$. The N→G change in $HC_I$ prevents antibody HC glycosylation. Hence, the effects of N→G and Y→V amino acid differences between $HC_{II}$ and $HC_I$ on expression of $HC_I$ were investigated. Two point mutations were generated, changing the G and V amino acid residues of $HC_I$ to N and Y, respectively ($HC_A$ double mutant or $HC_I$dm). The $HC_I$dm was used along with $LC_I$ and $LC_{II}$ to generate RTI pools and antibody expression in these pools were evaluated in production cultures (FIG. 16A). The findings showed that co-expression of $HC_I$dm along with $LC_I$ increased antibody expression to the levels observed for $HC_{II}LC_{II}$, suggesting that these mutations can restore the low expression levels of HCA antibody (FIG. 16A). Interestingly, when co-expressed with $LC_{II}$, $HC_I$dm achieved titers even higher than that of $HC_{II}LC_{II}$, suggesting that $HC_I$dm is superior in expression and folding compared to $HC_{II}$ (FIG. 16A). As previously observed, $HC_ILC_I$ had the lowest titer while $HC_ILC_{II}$ displayed an intermediate antibody expression profile (FIG. 16A). Western blot analysis revealed that expression of $LC_I$ was still associated with increased intracellular BiP accumulation, even when co-expressed with $HC_I$dm (FIG. 16B). FIG. 16C depicts a diagnostic roadmap of how RTI system can be used to dissect and identify the source of problem in cell lines that express hard to express molecules.

Example 8: Generation of TI Host Cell Containing Two Distinct and Independent Landing Pads Host 8 is a targeted integration (TI) host containing two distinct and independent landing pads, which can be targeted for expression of antibody genes individually, or simultaneously. The parental cell line for Host 8 is Host 7 (see Table 2) which contains a single landing pad. A second landing pad was inserted into Host 8 at the genomic location where the landing pad is located in the Host 4 TI host (see Table 2). This insertion was performed by CRISPR/Cas9-based knock-in of a new landing pad into the Host 4 TI site location within the Host 7 TI host.

To accomplish this, the genomic region of Host 4 TI site was characterized within the TI Host 4 and the TI Host 7. Based on this information, a guide RNA was constructed to target this specific genomic region to facilitate CRISPR/Cas9-based knock-in. Separately, a donor plasmid containing a newly created landing pad was generated to be knocked-in to this site and constructed together with homology arms corresponding to the genomic region upstream and downstream of the targeted knock-in site to facilitate knock-in, and additional genes to allow for screening of knock-in clones. Co-transfection of a plasmid containing genes for the gRNA and Cas9, and the donor plasmid were performed to facilitate the CRISPR/Cas9-based knock-in of the new landing pad.

Following selection and screening of clones that underwent CRISPR/Cas9-based knock-in, Host 8 was ultimately identified and underwent further evaluation. The existing Host 7 landing pad was determined to be intact, and the newly knocked-in landing pad at the Host 4 site location was also confirmed to be present, intact, and in the correct location.

Figure 17:
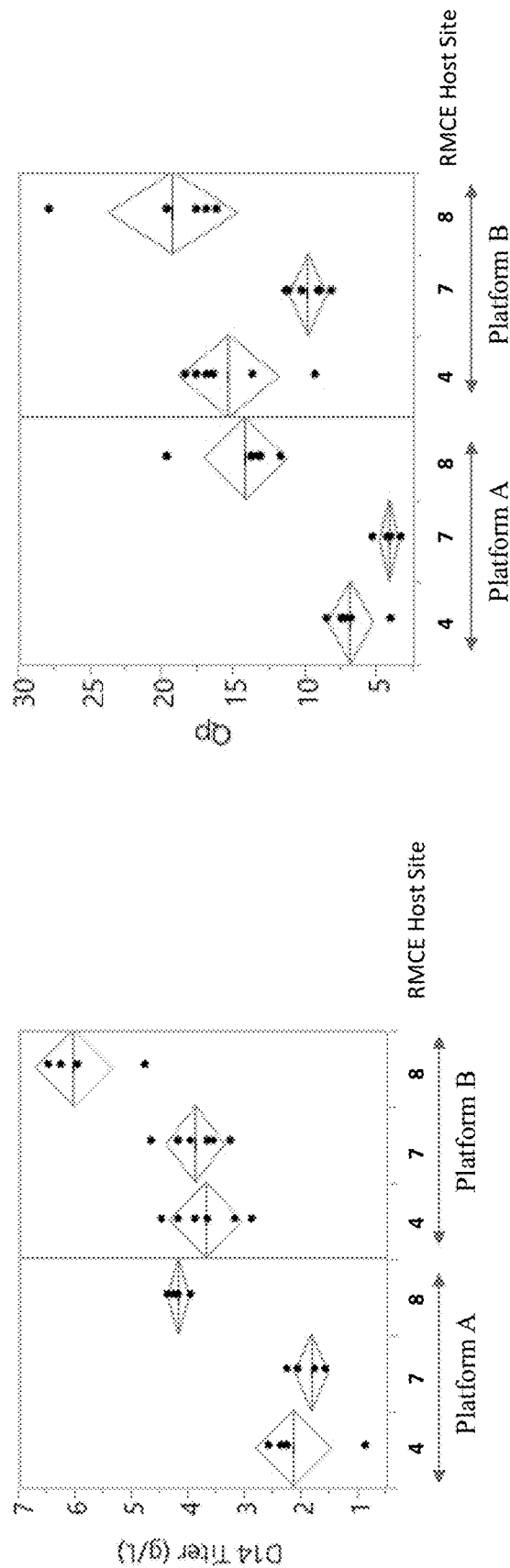
FIG. 17 depicts the production using two different cell culture processes.
Figure 17:
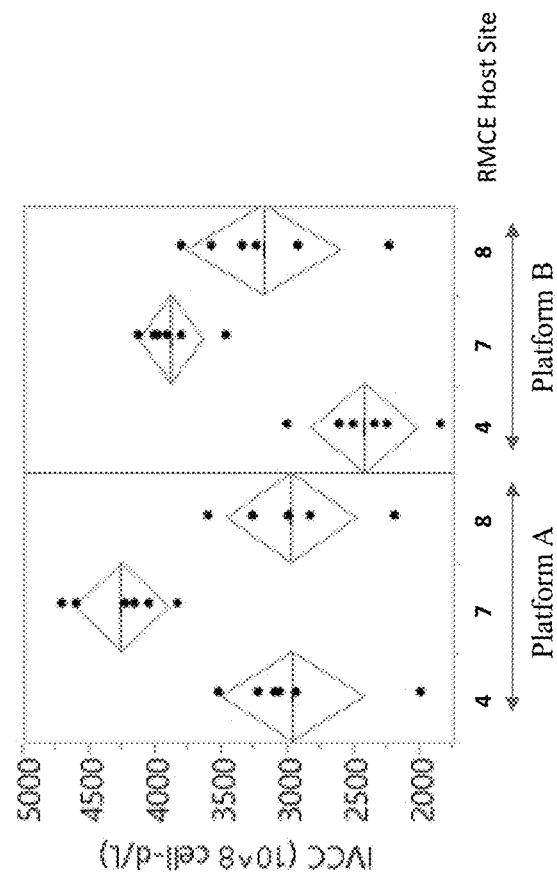

The feasibility of recombinase-mediated cassette exchange (RMCE) at both sites was then evaluated for each site individually, and then simultaneously. Clones were generated by RMCE at the Host 7 landing pad only, the Host 4 landing pad only, and both sites simultaneously, and then evaluated in a 14-day fed-batch shake flask evaluation. Titer and specific productivity of the clones expressing antibody at both sites simultaneously was higher compared to expression at each site individually. Further evaluation was performed in a different cell culture process, cell culture platform B, to show additional titer increase for all clones in comparison to the cell culture platform A (FIG. 17). The average 14-day titer for the Host 4 site was 3.0 g/L, for the Host 7 site was 1.9 g/L and for both sites simultaneously was 3.9 g/L at the platform A cell culture.

Ultimately, TI Host 8 was created from TI Host 7 by addition of a second landing pad located at the genomic location of the landing pad of the TI Host 4. Further investigation confirms knock-in of the landing pad and feasibility of RMCE at both, existing and new, landing pads. Further, evaluation of clones generated from Host 8 at each site individually and both sites simultaneously show productivity of antibody expression. The expression of antibody genes at both sites simultaneously, versus each individual site, have an additive productivity effect which is seen in both the cell culture platform A and in the cell culture platform B (FIG. 17).

Methods

Antibody Plasmid DNA Construct Configurations: To construct one-plasmid antibody constructs, antibody HC and LC fragments were cloned into a vector backbone containing the L3 and 2 L sequences as well as a puromycin N-acetyl-transferase (pac) selectable marker. To construct two-plasmid antibody constructs, antibody HC and LC fragments were cloned into a front vector backbone containing L3 and LoxFAS sequences, and a back vector containing LoxFAS and 2 L sequences and a pac selectable marker. The Cre recombinase plasmid pOG231 (Wong E T et al., *Nucleic Acids Res* 2005, 33, (17), e147; O'Gorman S et al., *Proc Natl Acad Sci USA* 1997, 94, (26), 14602-7, the contents of each are incorporated herein by reference) was used for all RMCE processes.

Cell Culture: CHO cells were cultured in a proprietary DMEM/F12-based medium in 125 mL shake flask vessels shaking at 150 rpm, 37° C. and 5% $CO_2$. Cells were passaged at a seeding density of $3\times10^5$ cells/mL every 3-4 days.

RMCE Stable Cell Line Development: Expression plasmids were transfected into TI hosts by MaxCyte STX® electroporation (MaxCyte, Gaithersburg, MD). RMCE transfection pools were then selected with puromycin and 1-(2'-deoxy-2'-fluoro-1-beta-D-arabinofuranosyl-5-iodo) uracil (FIAU) (Moravek). After pool selection, single cell cloning (SCC) was performed to generate TI cell lines for further evaluation.

Fed-Batch Production Assay: Fed-batch production cultures were performed in shake flasks or ambr15 vessels (Sartorius Stedim) with proprietary chemically defined production medium. Cells were seeded at $1\times10^6$ cells/ml on day 0, with a temperature shift from 37° C. to 35° C. on day 3.

Cultures received proprietary feed medium on days 3, 7, and 10. Viable cell count (VCC) and percent viability of cells in culture was measured on days 0, 3, 7, 10, and 14 using a Vi-Cell™ XR instrument (Beckman Coulter). Glucose and lactate concentrations were measured on days 7, 10 and 14 using a Bioprofile 400 Analyzer (Nova Biomedical). Day 14 titers were determined using protein A affinity chromatography with UV detection.

Gene copy number determination by droplet PCR: Droplet PCR assays were performed using ddPCR™ Supermix kit (Bio-Rad). Each ddPCR reaction containing ddPCR Master mix, 900 nM forward primer, 900 nM reverse primer, 250 uM probe, 3 unit HaeIII restriction enzyme and sample DNA. After incubation at room temperature for 10 min, the droplets were generated with Automatic Droplet Generator (Bio-Rad). The PCR thermal cycling conditions were 10 min at 95° C., followed by 40 cycles of 94° C. for 30 sec and 60° C. for 1 min, then 98° C. for 10 min to deactivate the enzyme. After PCR reactions, the droplets were read on the QX200™ Droplet reader (Bio-Rad). The data were collected and analyzed using Quantasoftware. The HC and LC gene copy numbers were normalized based on the defined copy number of reference genes Bax, Albumin, Hprt and b-microglobulin. The primers used in this study were designed using Primer Express v3.0 (Life Technologies). The sequences of the primers are listed in Table 4.

Quantitative Real Time PCR (qRT-PCR or Tagman) Analysis: RNA samples from seed train cultures were purified using Qiagen RNeasy plus mini kit according to the manufacturer's instructions. TaqMan RT-PCR assays were performed using TaqMan One® Step RT-PCR Master mix kit (Life Technologies). Each RT-TaqMan PCR reaction contained RT-PCR Master mix, reverse transcriptase, 300 nM forward primer, 300 nM reverse primer, 100 nM probe, and 10 ng purified RNA sample. The thermal cycling conditions were 30 min at 48° C. and 10 min at 95° C., followed by 40 cycles of 95° C. for 15 sec and 60° C. for 1 min. All reactions were processed on the 7900 HT Fast Real Time PCR System (Life Technologies). Data were analyzed using SDS v2.4 software (Life Technologies) after TaqMan RT-PCR amplification. The relative expression levels of HC and LC were determined based on the delta Ct analysis method. The expression level of a house keeping gene, cyclophilin, was used as reference gene to normalize different RNA samples in each reaction. The primers used in this study were designed using primer express v3.0 (Life Technologies). The sequences of primers are listed in Table 5.

TABLE 4

Primer sequences for droplet PCR.

| Primers | Sequence |
| --- | --- |
| Heavy Chain - Forward Primer | TCA AGG ACT ACT TCC CCG AAC C |
| Heavy Chain - Reverse Primer | TAG AGT CCT GAG GAC TGT AGG ACA GC |
| Heavy Chain - Probe | VIC-ACG GTG TCG TGG AAC TCA GGC GC-TAMRA |
| Light Chain - Forward Primer | GCT GCA CCA TCT GTC TTC ATC T |
| Light Chain - Reverse Primer | GCA CAC AAC AGA AGC AGT TCC A |
| Light Chain - Probe | VIC-CCC GCC ATC TGA TGA GCA GTT GAA-TAMRA |
| Bax - Forward Primer | ACA CTG GAC TTC CTC CGA GA |
| Bax - Reverse Primer | GCA TTA GGA AGT TTG AGA ACC A |
| Bax - Probe | FAM-CCC AGC CAC CCT GGT CTT GG-TAMRA |
| Albumin - Forward Primer | TTC GTG ACA GCT ATG GTG AAC TG |
| Albumin - Reverse Primer | GGT CAT CCT TGT GTT TCA GGA AA |
| Albumin - Probe | FAM-CTG TGC AAA ACA AGA ACC CGA AAG AAA CC-TAMRA |
| Hprt - Forward Primer | AAA GGA CAT AAT TGA CAC TGG TAA A |
| Hprt - Reverse Primer | CAA TTG CTT ATT GCT CCC AA |
| Hprt - Probe | FAM-CTG CTT TCC CTG GTC AAG CGG-TAMRA |
| β-microglobulin - Forward Primer | CTT CCT GAA CTG CTA TGT GTC TCA A |
| β-microglobulin - Reverse Primer | CCA TCT TCT TTC CAT TCT TCA ACA |
| β-microglobulin - Probe | VIC-TTC ATC CCC CCC AAA TTG AAA TCG A-BHQ1 |

TABLE 5

Primer sequences for Quantitative Real Time PCR

| Primers | Sequence |
|---|---|
| Heavy Chain - Forward Primer | TCA AGG ACT ACT TCC CCG AAC C |
| Heavy Chain - Reverse Primer | TAG AGT CCT GAG GAC TGT AGG ACA GC |
| Heavy Chain - Probe | FAM-ACG GTG TCG TGG AAC TCA GGC GC-TAMRA |
| Light Chain - Forward Primer | TGA CGC TGA GCA AAG CAG AC |
| Light Chain - Reverse Primer | CAG GCC CTG ATG GGT GAC |
| Light Chain - Probe | FAM-ACG AGA AAC ACA AAG TCT ACG CCT GCG A-TAMRA |
| Hamster Cyclophilin - Forward Primer | GCG TTT CGG GTC CAG GA |
| Hamster Cyclophilin - Reverse Primer | GAG TTG CCC ACA GTC GGA A |
| Hamster Cyclophilin - Probe | FAM-TGG CAA AAC CAG CAA GAA GAT CAC CA-TAMRA |

Western Blot analysis: Cell pellets from seed train cultures were washed with PBS and resuspended in NP-40 lysis buffer with the mini cOmplete™ cocktail of protease inhibitors (Roche). Cell lysates were centrifuged at 13000 RPM for 10 minutes and the supernatants were collected. Protein concentration for each lysate was determined using the Pierce BCA Protein Assay Kit (Thermo Scientific). Equal protein concentrations of each lysate were mixed with SDS-PAGE buffer and NuPage Sample Reducing Agent (Invitrogen) before being heat-denatured for 5 minutes at 95° C. The lysates were then loaded onto NuPage precast 4-12% Bis-Tris gels (Invitrogen) and electrophoresed. Protein was transferred onto nitrocellulose membranes using the iBlot system (Invitrogen). The membranes were blocked for 1 hour at room temperature using 5% nonfat milk solution in tris-buffered saline containing 0.1% Tween 20 (TBS-T). After blocking, membranes were incubated for 1 hour at room temperature using specific primary antibodies and then washed 3 times for 10 minutes with TBS-T. Secondary horseradish peroxidase conjugated antibody was added for 1 hour at room temperature, followed by 3 15-minute washes with TBS-T. Membranes were developed using either the Amersham ECL detection reagent or Amersham ECL Prime detection reagent (GE Life Sciences). Image Lab 5.1 (Biorad) was used for band signal quantification. The following primary antibodies were used: 1:3000 goat anti-human IgG-HRP (MP Biomedicals) and 1:2500 mouse anti-β actin (Sigma Alrdich). The following secondary antibody was used: 1:10000 sheep anti-mouse (GE Healthcare UK).

Example 9: Addition of an Extra Light Chain to the One Heavy, One Light Chain Plasmid DNA Configuration Improves Antibody Titer and Specific Productivity To examine the effect of antibody copy number on productivity in the TI host, RMCE pools were generated by transfecting a single plasmid containing either one heavy and one light chain (HL configuration) or one heavy and two light chains (HLL configuration). After selection, recovery, and verification of RMCE by flow cytometry, the pools' productivity was evaluated in a 14-day fed batch production assay. For three separate antibodies (mAb-Q, mAb-S, and mAb-T) an approximately 2-fold increase in titer for the HLL pools compared to the HL pools was observed, driven largely by a 1.5-2.5-fold increase in specific productivity (FIGS. 18A and 18B). Additional single cell clones were generated from the transfected pools by using limiting dilution and confirmed that titer and specific productivity are also higher in HLL configuration derived clones than those from the HL configuration (FIG. 18C, 18D).

Example 10: Transfection with Up to Seven Antibody Chains in RMCE Pools Increases Antibody Specific Productivity and Titer The effect of increasing the antibody chain number on expression of the antibody was evaluated. The HLL single plasmid configuration was compared to the HLL-HL or HLL-HLL dual plasmid configurations for five antibodies.

The HLL-HL (five-chain), HLL-HLL (six-chain) and HLL-HLHL (seven-chain) configurations for mAb Y were compared. Titer and Qp of RMCE pools in production generally increased from the HLL-HL to HLL-HLL and HLL-HLHL configurations (FIG. 19A, 19B), while growth (represented as the integral of viable cell count, IVCC) among the different pools was relatively equivalent (FIG. 19C). Looking at seed train antibody mRNA expression in these pools, an increase in light chain mRNA going from HLL-HL to HLL-HLL and HLL-HLHL, as well as increased heavy chain mRNA in the HLL-HLHL pool compared to HLL-HL and HLL-HLL pools was observed (FIG. 19D). The intracellular protein levels of heavy chain and light chain from these RMCE pools were also measured using western blot. Intracellular light chain protein levels closely matched what was observed for light chain mRNA, with increases from the five to six and seven chain configurations (FIGS. 19E, 19F).

Example 11: Single Cell Clones with the Seven Chain HLL-HLHL Configuration have High Titer and Specific Productivity in Two Tested Antibodies To evaluate whether the high titer and productivity of the seven chain configuration HLL-HLHL is maintained after single cell cloning, single cell monoclones from the HLL- HL, HLL-HLL, and HLL-HLHL RMCE pools of mAb Y were generated. These monoclones were then evaluated in a 14 day fed-batch production assay. Looking at the top 6 clones from each configuration, it was found that titer and Qp increased slightly from the HLL-HL configuration to HLL-HLL and HLL-HLHL (FIG. 20A, 20B), as growth remained similar (FIG. 20C).

To confirm that the HLL-HLHL configuration results in high monoclone titer, a different mAb, mAb III was used to generate single cell clones, derived from Host 4, from HLL-HL (five-chain) and HLL-HLHL (seven-chain) RMCE pools. After evaluation in a 14 day fed batch production assay, a clear titer advantage of the HLL-HLHL clones over the HLL-HL clones was observed (FIG. 20D), greater than that seen with mAb U. The titer increase appeared to be driven primarily by the higher Qp of the HLL-HLHL clones (FIG. 20E), with little average difference in IVCC between the two configurations (FIG. 20F).

Example 12: Antibody Chain Position in a Transfected Plasmid Affects its Productivity The effect of the position or arrangement of heavy chain and light chain in the transfected plasmids on antibody expression was also evaluated. To do this, RMCE pools were generated with plasmids containing several different configurations of one heavy chain and one light chain of mAb Z. Since the TI hosts of the present disclosure support integration of two different plasmids at the same integration site, the position effect when both heavy chain and light chain are expressed from the same plasmid as well as when they are separated on either front or back different plasmids was examined (FIG. 21A).

After generating the RMCE pools, the mRNA expression level of antibody Z heavy chain and light chain in seed train cultures were measured. The mRNA expression of heavy chain decreased when it was preceded by light chain, with the LH configuration in both front and back plasmids having lower heavy chain mRNA expression than the HL configuration. However, the effect of position on light chain was dependent on which plasmid it was expressed from: in the front plasmid, light chain mRNA expression increased in the LH configuration vs. HL but the opposite was true in the back plasmid. It was also observed that while a light chain cassette on its own in the front plasmid expressed a high level of light chain mRNA, a single light chain cassette in the back plasmid had the lowest light chain mRNA levels of any configuration (FIG. 21). In general, lower mRNA expression levels for both heavy and light chain in the back plasmid compared to the front plasmid were observed.

A fed-batch production assay of these different RMCE pools produced a range of titers and specific productivities similar to the trend in antibody mRNA expression (FIG. 21C, 21D). The LH-no mAb configuration had higher Qp and titer than HL-no mAb, while the pools with the lowest level of LC mRNA expression—H-L and no mAb-LH—also had the lowest Qp and titer.

To confirm that the observed mRNA and antibody productivity differences are due to antibody chain position and not variation in absolute copy number, digital droplet PCR was used to measure the pools' heavy and light chain copy number. As expected, all pools had approximately one heavy and one light chain DNA copy (FIG. 21E).

Figure 22A:
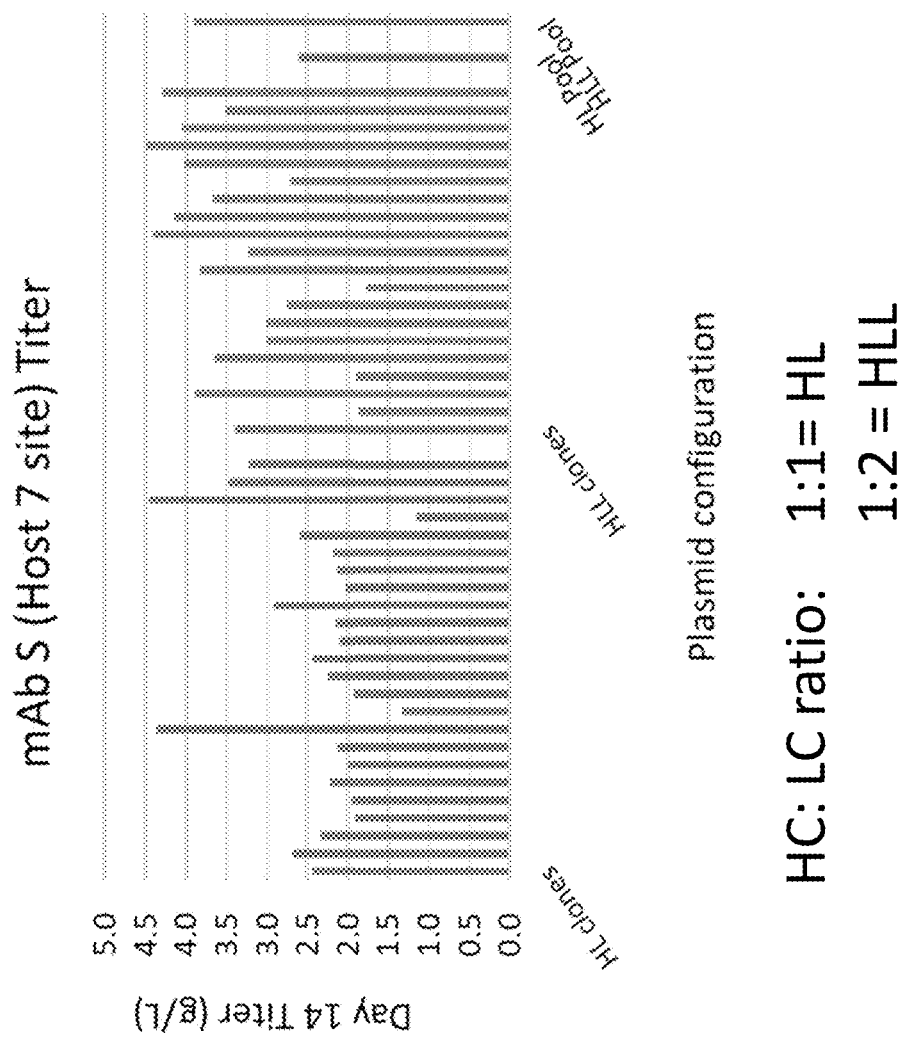
Figure 22B:
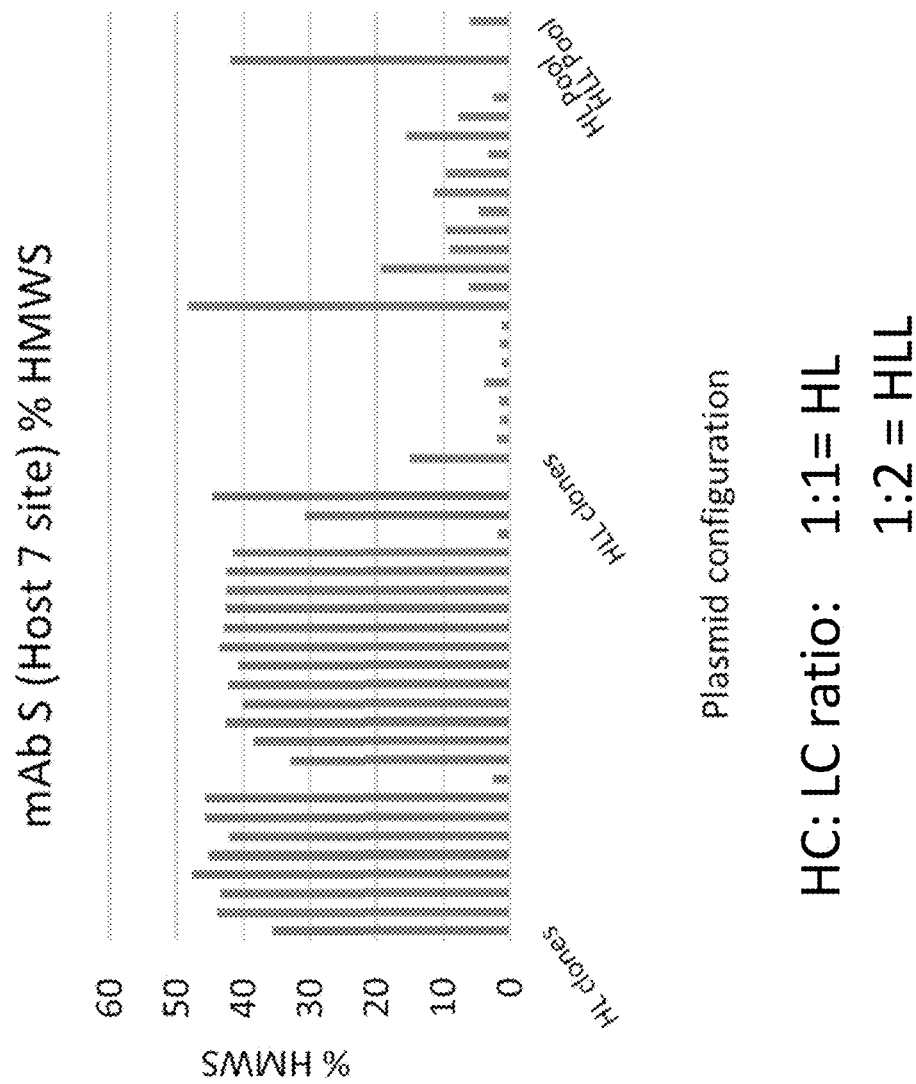
Figure 22C:
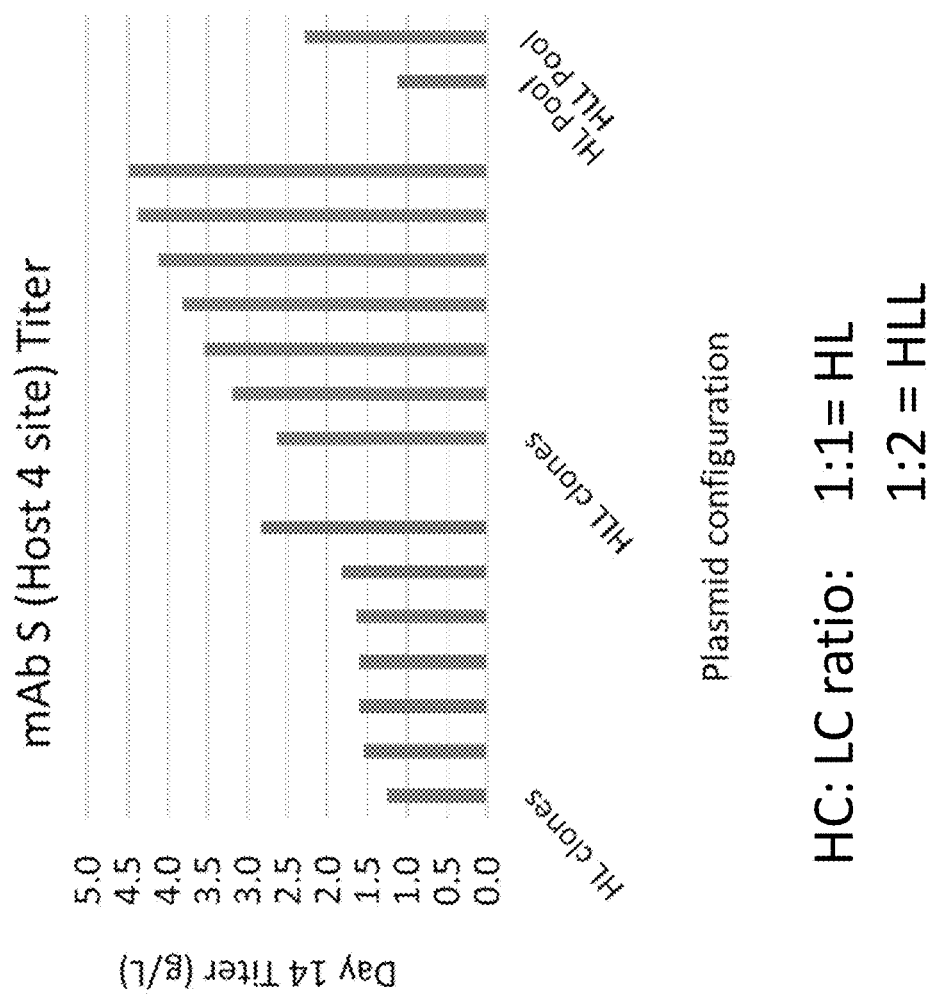
Figure 22D:
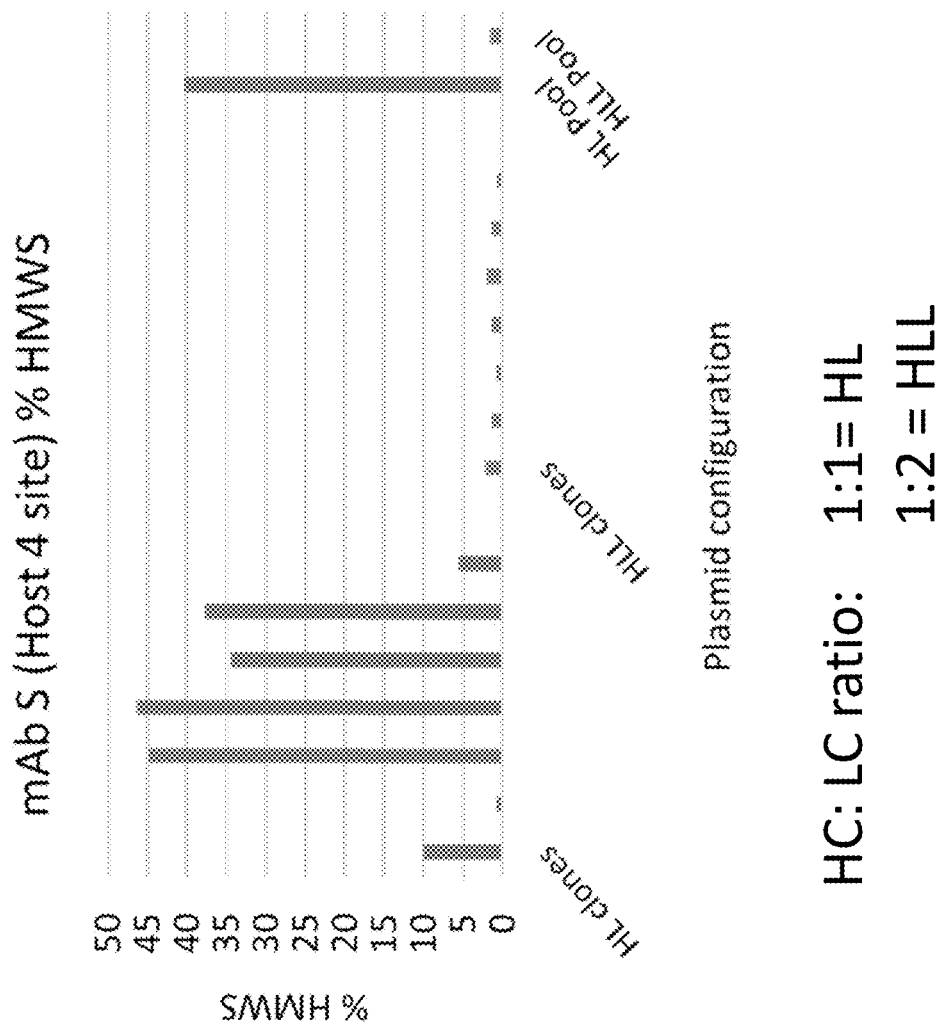

Example 13: Effect of HC to LC Ratio on the % High-Molecular-Weight Species on mAbs The effect of the HC:LC ratio of antibodies on productivity and on High-molecular-weight species (HMWS), such as aggregates, was evaluated. Furthermore, the effect on the TI site was evaluated by using cells with different TI sites. To do this, RMCE pools were generated by transfecting a single plasmid containing either one heavy and one light chain (HL configuration) or one heavy and two light chains (HLL configuration) in TI Host 4 or Host 7 locations. The pools' productivity was evaluated in a 14-day fed batch production assay (FIGS. 22A and 22B). The % HMWS was evaluated (FIGS. 22B and 22D) showing that the effect of HC:LC ratio is independent of the integration site.

The effect of increasing the LC copy of and antibody on the productivity and on High-molecular-weight species (HMWS) was evaluated, in connection with mAb IV. To do this, RMCE pools were generated by transfecting a single plasmid containing either one heavy and one light chain (HL configuration), one heavy and two light chains (HLL configuration), two heavy and three light chains (HLL-HL configuration), two heavy and four light chains (HLL-HLL configuration), two heavy and five light chains (HLL-HLLL configuration), three heavy and 6 light chains (HLLL-HLLHL configuration), or three heavy and 7 light chains (HLLL-HLLHLL configuration) in Host 4 site location or in Host 4 and 7 site location (FIGS. 23 and 24).

Through a number of titer and production evaluation assays, a number of clones were identified and evaluated in an ambr15 production evaluation with a specific production process. From this evaluation, the top 10 clones, identified by cell culture performance, titer, and product quality attributes (including percent aggregation), were chosen to be banked for further evaluation. Ultimately, 2-site integration cell lines were generated expressing mAb-VI with high titer, lower percent aggregation, and comparable production quality to previously generated mAb-VI cell lines. FIG. 25 shows the top 2 clones with titers of 8.4 and 8.7 g/L with 7.4% and 5.6% aggregates, respectively.

Example 14: Regulated Targeted Integration: Clone Evaluation

In this experiment the expression of antibody Z, in a regulated derivative of Host 4, was evaluated after the regulated targeted integration of a sequence encoding the antibody was performed. The system employed for the regulation of the expression of antibody Z is composed of 3 key components: 1) Regulated promoters that include tandem tet-operon sequences prior to a signal sequence, 2) Promoter and Tet-repressor protein coding sequences, and 3) an inducer, such as doxycycline, to allow for expression of antibody Z.

Upon confirmation that targeted integration of the sequence encoding antibody Z, clone evaluation was performed in a shake flask process A 10% feed (of the total volume) on days 3, 7 and 10 was performed. One production culture assay was carried out to evaluate the clones. All clones were inoculated at a seeding density of $3\times10^6$ cells/mL on day 0. On days 3, 7, and 10, 1 µg/mL doxycycline was added to all 36 cultures to induce expression of antibody Z.

Final titers and specific productivity (Qp) are shown in FIGS. 26 and 27 respectively. Day 14 Harvest Cell Culture Fluid (HCCF) was submitted to titer analysis. Titers ranged from 1 to 3.68 g/L (excluded clone 7). Clone selection for banking was first ranked by titer and final selection was based on cell culture performance, including Qp and other parameters. The selected clones for banking produced titers ranging from 2.69 to 3.68 g/L.

In addition to the various embodiments depicted and claimed, the disclosed subject matter is also directed to other embodiments having other combinations of the features disclosed and claimed herein. As such, the particular features presented herein can be combined with each other in other manners within the scope of the disclosed subject matter such that the disclosed subject matter includes any suitable combination of the features disclosed herein. The foregoing description of specific embodiments of the disclosed subject matter has been presented for purposes of illustration and description. It is not intended to be exhaustive or to limit the disclosed subject matter to those embodiments disclosed.

It will be apparent to those skilled in the art that various modifications and variations can be made in the compositions and methods of the disclosed subject matter without departing from the spirit or scope of the disclosed subject matter. Thus, it is intended that the disclosed subject matter include modifications and variations that are within the scope of the appended claims and their equivalents.

Various publications, patents and patent applications are cited herein, the contents of which are hereby incorporated by reference in their entireties.

SEQUENCE LISTING (7 sequences)

SEQ ID NO: 1 - DNA, 3974 bp, Cricetulus griseus
cgcgacaccgattctcactctcatttggagttgggctctgagataatccaatcactgtcgctctggtttgtaaatttgcccaagatctgcccagaaccagactctcagtgtccccaaggatgggggccactgtgcaccctgctctcctcctgctgcttgcagaccctgtgttctgggctccaacccgcgcaggtgagtgccacccaggggaaaaatggcctcggcggcaaggggtgggggcggcacccgggaagccgcatcttccaaactctcagccagaactttcagatccattctccacctgcatccctagacccgtgccctgctcccttaccagcccggtgcacctgccaagaggtgcgggtctcaccgctcaccgcccccaggctcacactcgctgctgtatttctacaccaccgtgtcccggcccggcctcggggatccccggttcattttcgtgggctacgtggacgacacgcagttcgtgcgcttcgacagcgacgcggagacgcccagagtggagccctgtgtagggtggatggaacaggagaggcctgagtattgggagctgcagacccagatggcctggactcaagcaaagctgtccggtgggagcctgatgaccctgcttcgctatttcaaccagagcaaggacggtgagtgacccagacactttgggagcaccaaggttgtccagattcactggactggagtatcaccctagacctgcccggttcgttaagcagaaaagggcccgcagggattcgcttggacttggtctgaagttagtggtgctgcgcttcctaagagggctgaccaccttgtccccgctagactctcacacgctgcaggggatgcgtggttgcgacgtgggggcagatggacgcctgctccacgggtacaaccagctgggctatgatggagaagattacctcaccctgaacgaggacttgagctcctggacagcgaccttaggtcagatctctcagggcaagttaggagaccacttgaaggacagctgcgtggagacgctgcacaaacacctggaaaaagggaaggaagtgctgctgcgctcaggtgcccggggagccacaccccgcccaagtttccctctggctgcttgctgggagtttagagagctgggggtgcctgcatgggcaggatgagagcacttggggatagctcacaggttgagtgctgcccagcaggacaggttctgggttagagcctttccttttccggagggggaggagagggaggcaggtgaaccagagggccttagctcactcctccccagagtccaaggaggcaggagacaacttggttccaaatctttgaccaagaatgaatccctcagaggacagcccttctcttactgccagtaaagaaattcattttccctaacagtagaccaaccttttagtaactgatcaacagttcctttacttgggcaatggacctggacccataggaggttttttctctcaggcctcctccagtgtatctggagtctggatcctgcttttctgagtctcctggccctccctcagctcaggaccagaaaactcctcccatccatcagtctgcagagccctgaagccccctaccctagagcaccccaaagaacagattacccccagtgcctgctctacttggggtctattaatatatggacacctaatcccaccccagttctgctgtccattcctagaatggtcacatgaacactgctgagtccccaggaaaaagccagatgcctgatcttcccaactctccccctcagaccccccaaaggcacatgtgacccatcatcctggatataaaggtgatgtcaccctgaggtgctgggctctgggcttctatcctgctgagatttccctgacctggcagttggatggggaggacctgatccaggaaatggagtttgtggaaaccagaccagcaggggatggaaacttccagaagtgggcagccgtggtggtgccttctggggaggaacagaaatacacatgccatgtgcaccatgaggggctgcctgagcccctcaccctgagatggggtaaggaggaagtgggtgcagagctggaggcagctgtagtcagagcttagaactgggtggtcctcatctccccctcctttcccagagcctccttggaacaagaaatattggtttctcctccttatcctcatcctcatcacagtttgggtgctttgcatatgtaagaagaaggatgcaggtaggatgctgagtttacttgtcccactgagggcttcaagccataggtggcagtgtcctgcctaggtaatgggatgtaccatccacagctctgtgtctccttcatttgtgacctttttgtttaggcttcaaaagtagagaagggaagatttgcttgggggatggttctggtgactgagatctcatgtccagctgtcgcaagcagaggtctcactaaggacaaacctccaggaagctattacaatgtctcagttctcgaaatttcccttgggctagggactaaggttcccaaccctttggaggtcacattaagatatccttcgtatcagacttgcattatgattcatagaagcaaaatgacagttacgaagcagcaacacaataattttatggccggtggctcaccacagcatgaggagctgtgtttaagggtggcagcatgaggaagtgcctgctcccatgatacccatacatggatttctttcctcaggtgggagaggaaggagccacactcaggaagaaggtaagtgtggtgagaggtggtgtctgagactcttggagtccatgagagctcacccagcccatagtcccccctcaacctccagtcttctgaagcctgaccaggtcctgctctgttctttcctaggcaggaacagtggccaggactctggtgagacggccgtggatgatgaggtgatatgtggggaaagacagacgacacaggttggggctggagagagtctttgcactcagacatttagagtgaggaggaagctattcagaatgtcaccactataccgtgacatctgccttaatcttgtaggagatggtcattctctctggggagcctgagccctctcggaatcgtccagaccactccttcagactgagtgatctgtcattctgaaaaggtatctgattgtcctccctctactctgtggcactcagaagtctctgcttagtcttctcgctcagggacacccccacttccccgccctctcccacacccaactccatgtggaagtgcctggaacagctactacagaatggaatcttttgttttgttttggtgacagggtttctccatgattcagtcctggctgccctgtaactcactctgtagcccaggatggcctcgaacccacagagatccacctgcctctgcctgccaagtgctgggattaaaggcatgtgccaccaccatacagctcagaatggaatcttctgttttgtatatcaccagacatcttcacagtcaacttgactggacttagaatcacctagaagccgcccctctggatgtgtctgtgagggtgtttctagccaggtttaacccaggaggaagaaacaggttgactgtaaggtagcttcactcacagctggagtctgaagagaaagccagcaggacactggagtcccccttcctgtgtttcctaacaggacatgagcaggccatctcctgccaccatgaacagagacaggtcccacttttctgtcttgaacatctgacacctgtctcttccctaagtggcttctcatcaggtattttttgtcgcagggcacagggttagacacaaagctccttccccacatccaaggcttcctgagcatcactccctaatcttttagagactttcactcaggccaaactgggatctatggctttggtgcggaaaaggattatggactactagagctggtgtttaataaacatgtttctatttgtttttaattttaa

SEQ ID NO: 2 - DNA, 247881 bp, Cricetulus griseus
  misc_feature (27878)..(28464): n is a, c, g, or t
  misc_feature (32310)..(32559): n is a, c, g, or t
  misc_feature (44725)..(44763): n is a, c, g, or t
  misc_feature (52911)..(52984): n is a, c, g, or t
  misc_feature (54132)..(54158): n is a, c, g, or t
  misc_feature (55328)..(55418): n is a, c, g, or t
  misc_feature (61688)..(61819): n is a, c, g, or t
  misc_feature (65710)..(65816): n is a, c, g, or t
  misc_feature (76404)..(76428): n is a, c, g, or t
  misc_feature (81914)..(82028): n is a, c, g, or t
  misc_feature (99280)..(99312): n is a, c, g, or t
  misc_feature (103366)..(104009): n is a, c, g, or t
  misc_feature (104456)..(105181): n is a, c, g, or t
  misc_feature (105312)..(105349): n is a, c, g, or t
  misc_feature (105697)..(105860): n is a, c, g, or t
  misc_feature (106069)..(106131): n is a, c, g, or t
  misc_feature (118030)..(118158): n is a, c, g, or t
  misc_feature (149844)..(150135): n is a, c, g, or t
  misc_feature (180498)..(180511): n is a, c, g, or t
  misc_feature (183367)..(183466): n is a, c, g, or t
  misc_feature (192091)..(192520): n is a, c, g, or t
  misc_feature (196828)..(197583): n is a, c, g, or t
  misc_feature (197889)..(197995): n is a, c, g, or t
  misc_feature (198807)..(198816): n is a, c, g, or t
  misc_feature (200258)..(200402): n is a, c, g, or t
  misc_feature (203405)..(203415): n is a, c, g, or t
  misc_feature (210100)..(210542): n is a, c, g, or t
atgaatctgagagtcagaagagacatgaaggctgcagacaaaattctgataagcatacaggtaagagttgaaaccatgagtatgtgtgataatatccagggaatgtgtaaaaaataaagaaaactacaaaagccaaactctgatgagtttcatgatttaagaaagtaaaagcaatccattgtcacaatgtgtgataagtaccacttaaaggcaaaaataagatactctagtgactcaaaataagattggctagcttgtgatgagatactgcatgaagggctttacttcaatttaagggatgtataggtgtgtgtggatggaattggggcaagaaaacaatcatctattttacaaggaaaacaaaggacttcaaatgaaaaaattctcaagcatccttcagctgtatatcctagtatatgggcagtgttcctcaaagtgtggtcaacagttcactggcatgagagactcacataaggcatttatcaaaacaaatactatattaaattttgtgcaaagtaattgaaggtgtgaccttggaagaagcagctagagtgaagtgggcctaaaggctttggagttgatgagttcaaaaaattggaatcttaaatttgccagcattagcagggaggaagtgggaaatgaagtgtttgtagattgggatgttttgcaagaatataattgacttcataggttttgctttacttaagctgaaaaatgagccaaacatgactaagacgagtagctatcctctaagctggtcccaagttacccaggacatacacaaggtcaactccgtgaaagaaaaatgaacacttgatttggttgactgggtgtggtcattaaaacactaatgacaaaaacacagccatgaattaccctgggtttgctttcacttttttagcttgttatctgacactttatcagcctttcctaatgaactgatactacctaaaattaccaagtgtttgctttacaattcattaataatattggagataaaaatttccatgtttccttaatttttatcctaaaaaagatttgtttttaatttgcctgtttgttttctaaagatagggagaaaggtggcatgaagttagatgaacagagaagtagagaggatttgagagaagatgggagagggaaaacagagatcagaatatattgtatgaaaaaataattttgataaaaaggaattttttttaaaaaagaaagctactgttaagtaagaaaaagtgtttaaagaaagatacatcagggttggaaaaatggctcagcagttgagagcactggctctccgggggaccagggttcatttcccagcacccacatggcagctcataactgcctatgattccagtttcagggaatccaacaacttcacacaggcatacatgcaggcaaaacatgaatgcacatgaaatcaaaagggagggttggtggagggtgagagaggagagagggagagggagctgggattgacatgtgaagcaagcttgttgttaattttaaaaaataataataaagaaaccattaagaaaaaagaaagatacatcatgataagtttagaaatgccttgcttgaagggacatcatgaactaggtaaaccatgaattaatcttttgtctttatggaatcacagggctttgctttcacattaaattgatggcatacatacatacatacatacatacatacatacatacatacatacatacatacatacatacataatacatacatatatcctactgtgatgagaatccttcttctgagtaatctgttaatgcgctttgttactgtgtcaaagaatctatctatatgaccttccagagttgggcacatcaggttagaatcatggcatcaaactttcttaccttttggtttcagaataagtccaatgttcttagtcatcccctgtaacttctctgggaaaaaagatatataaacaattgtcctcttcaaagctagtattatacctggccctttcctgagatacgattaatttagttcttacttcaaaacagaacataaagaatgataaaaatttcattaaagaactagctcttctcttcacagatatattaattttgtttataattcaatgttttctaacataaattttctggaccacatattgtgttattaagttagtaatgaatgcgaagcagatggcatagcctccattaaccaggaattagaaggctttctaggacatgtaagaggtataaaagggaaaataagctgtcacttatgttgtaatacttttggttggtcgctatatgagatgagaaattcttgaagaaaaagaaagaaagagcagtaagaaggaagaaaggaattgaaataagaaaaaccaagcaaaaagaaaagaaaaaagggaggaagagcctcgaaacttaaaggaaaacctttaagttttgcacagttctacagggaaagacactaaagcaatgaaacactgggccactagagagttacatttttctggaacgtatactaatattcctataggaccatgacatttattttgtattagaaaatattacatttactaaaactaccttgcagtgattttattagtttagcctgctattgtattaactgctagcgctccccagaatgttccatgaagtgggtgacttaaaaaatagataattattttctaacaattctgaggggtaaaagttcaatgtcaagcagtatggcttccttctaaagcctatgtccctaacttccagataactgtctccttgtgacttcacaaagtctttctctgtatgtcctaattttctcttcttataaaaacacaagtcataattgatttggaccccttattttaacttaattacctcttaaaaggccccatctttaaatactgtcatatttttaaataggatttcaacatgaattttggcagaaactgtttaacacataacacttattacttcagattttcacatacattaacacaaaattccatatatgcatacataatgcaattttaaatgtatttatttacttgtgtgtatctacttatcctgtgtgcacatacatacaccatggtgtgtgtatggaggtgataggacagctattccaagtcaattctcaccttctacctattgaagatgggtctcttatttctgtcacactacgtactccaagccatctggcccattcccttccaagcaattttcctggctcgtctgcccattttaccaatttccctgcctcctctacccatttcaccttacgagtgttcggcttgccaatgtacacaaccacatctgaattgctgtgagtctggggattaagtagtcaggctattacagctattgctcataatatcaatttgtgagttaccattttataggttttatccagctgagcctggtggcatatgattttaaccacagcatttaggaggcagaggcagggagatatctgtgagtacagtgccagacagggcttcatagacactctgtctcaaaataagtaaacaaacaaataaataaacaaacctgccctttaaaataaaggtctattccacgggaggaatccatgagcatgttctattgcccatgctttcctaggtacttaagtaggtgttatggctaaaatgaaaaaaaaaaaaaaattttgtttcccttgaagacttttgagatcagaaagaatagaaatagcataaataagcaagcacaataaaatgtattaaatactgctaaaggaagaaacgaagttttgaaagccaaatttagttagacccatagcaagccagcaaaggtgaagcaatatattagttacagaatattgctgtgctggctcttttttttttatcaactttatgcagagtcgcctgggaagagggaacctcaactgaggaatggcttccatcagattgccctttgggcgagcctgtggaggcattttcttgattaattattgatgtgggagggcccatcccactggtactttgccacccctggcaagaggtactgagttatttaagaaacactgaacaaagccacagggggcaagccagttaagcaacacccatggcctctgcaccagctcctaccaccaggttcctgccctgtttgagttcctgctctgactttctccaggaatgggctgtaaagtgaaagctcaaataaacccttttctccccaagttgcttttggtgaatactttatcacaacaacaggaaagtaaactacaactaattatcgacctaattaacaccactacataaagtattaggtcattattttttgtaatatgtaatttattcatccatttagcttttattctgaaatttgaaaaaccacttactatagatattgaataaaatatattataaaatactatgttccaatttgtcaaaaagtctatagaaatatattagttttagcatgaaagatggtcatgatttgattttgcataatatgttacccaaattaaaaataatcctgatagtatactagaagttaagctatcattatacacagggatatgtataggtgtgggggtggagggtaaaagagagagtgtgtgtactcagaattctaaggactgctcaaaaaattatgcatgagttgtttgccaagaactataacatatcccctaaagatatgcaacaaccaaacaaccatagaaaaaaatgtggtgagttaacacaattcattatcaagtcctatatcatttagatagcattatttatcttaaaagtttatcttgatattatgatgcacttcaagaagcatttagttcagcttagttatttttataaagtcacatttttcctgacccctgaggataaacatatcataaagactcacatacaccagtgattcttaactttaagtttcttttctctttggtctttcaaagacattcatagaagtggaaagaggagttttttgatcactgtaaacaccatcatgaaatcaaggaaagaatcctgtttgttgttgtaatagactcaaaatagtagtctttgtataacaaattaagagaaatatgacataaggaaatatgacttaaggacagaattgttaagagctaaagatcttagttcataaactatagacagacagacagacagacagacagacagacagacagacagaattagaatggcctacaggctgtggtgaatgttgggtttttagttaatttctgatgcagtcaatttgacagacaataaaagccatcacatctatgtaatacaaacattacacaagacttctgaaatgaccatttataatatgcaacaagctctgtaagaaaaactactttgttttatagctacttaatatattcttttaaaactgtgatataattaatataccataactctttcaaaaatatgtagctcagaagccagtaagcaggctcagcaggtataggtgcttgctgctaagcctgaaaacctgagttttattcccagaacccatgtgatggaaattgtcttaggatctccacacattaccctacccagcaacacaaataaacaaacaaataactaggtaaatgtgtatatcaataactgtatagtttgactatattcacaatgttataaaactatctccactctaaactgccagtacatattacattaacaataaataaataaataaataaataaagcatttcttttacctactcagaatacttgaaagattgatgagtctttgcttttactaatttgccacttctggacatttcttataaatggaatcataatttgtcactctgttattggttccctatacttagtgcaatgtgttcaaatgagtcaatttttttgttttgttttttgttttttgagacagggtttctctgtggctttgcaggctgtcctagaactagctcttgtagagcaggctggtctggaactcaatgatattctagttaattgtcatagtgcattttgcttatccatatataaattggtgaacacttggattgttttgtctgttggctactatgaacaatgttttagttttcaatggtgtttttctgaaatggcaaaagtatttcactttggtaaagttgagttcatctatttatttttcaacattgtcctttgatgcttatatagaaaaaccaatatcgagaacattacatgtaagccaggcttggtagcacacacctttaattctagcactctgcaggcagaggcaggctgatctctttgaatttgagcccagcctggtctacatatggaattctggtacagtcaagactacatagagaaaccctctcccacacatacaaacaagaacattaaatctatattttatcccaggtgtgctatacattagattttcatttggtcttttgatttacttagagttactttttgtatattgtataaaatatgtatgggcccttctatatttgtcttggtcaataaaactttatactaaatgttgaaatcaagaagttaacaaaagtctaacccttttctagcaattactattcagcactatgaattgtcattccagtctatactactcagcatcagaaaaagaaatgaaaagcaaccaggttgcaaaggatgaagtaaaattgtcttttttttcttgcagaagacatgattttgtatatagataatctaaaagcatctacaaagaagctactagacttcaaaaggggggttagccaagctgcaagaatcaagaatcaattcatttcaataactggaatgtatttctatagtctaggaatgaacaattgaatactacctttttaacttttattgattctttgcagtttttacatcatgcattcccatccctcttatccactgatatctaccctctacccttgcaacctcccatcccctaaaacaaccaaaacccaaacaaaacaaaagaaaggagaagaatcttgtggaagatgtagtatggcctattgagtcacacagtttaccctttagtccattcatctttacttgcaagtgttcattgctaagagtcattggtctggctcaaggcctctggcttctactatgccactgataatggggatcctcttggatatcctgatctacagaatatgacatttaaaatgttttaataacataggtatttttaatgacaatgagaaatgttttctcctgacggcaccaatgtacttcagagaagatgataggaattgaagaaacttcacatggattcaccaagataggataggatagaaggtgtagttccatgtaggttccccagctgtcagtccatagtccttgaactcccattagcttgggtcagctgtctctgtggttttcccccctcatgctcttgacacccccccattcatattatccctcccccctctcttcaactgtacttcaggagctcagcccagtccttggctgtgtgtcactgcctctgcttctttcatagactctttaagtcatttattcacttcctccttaaaggcttctataatatgcataagggttactttaaggactttgtcttattcttctgctatgttgcaatactcagactctactgtggtagagtcgctgggctccagtggagacatattgtcttaactgttattgatttgtgtttgtgctggtgtcttggcatctgggtttggaagattgaaattcccgaggtgatgatatgtggtcttatctttgttgggtgttttccacgctggtttctgctttcctctctgcttcctaggaaggtgttgagactgtgtgttgcctgataggagattcttttgggatcccgctaggtacagtggggtttcctggtaaaatgtgtttctaggtattgggagctgattcttaggaatggggattgtctggggtagtggcaagggggttcacaggaggaaggaaaacagggtgttccaccaggatctgcttagtcccctgggaatgtgggaaaagagtgagaagaggccacaacaggtagtgtgctacagaattgttgatgaaactaagggataggatatggagaaagtaagagaatggtgaaggtctgcagttagtcttttccccctacctggactggccttcaggtttccaaggaatgcttattgggattaggcactgggataaagcaatgagctgggaaaagaaaggcttgaggggaagatctgtgtgttccactagagatgggggcagggaggtaggtgaggatacagcagatggcctgctacagagcaaaaggaaaattggatttggagcagaggatctgtagttattttccctcccttgatctgaatggcctgcaggttccaggtgaatgcccattggaattgggggctgggataaagtaatgagtgggggtcagaaatttggaagtgaagatctgtgtgatccattgacgatggcaggcctgggacattgctgtatgggttctgctgcaaggctggggataagactggggtattggatttgagggtgtggaggaagaagaaagcttcggcagttagcttgtcttcgttcctggcctgtatgccaaatttaaaagtaaataaaaagaaaaattgtaaagctttaaaaattaaaaacaaaacatttgagggaatgaaacgtaacagcattcataatgtgcttgttatatgccaagtactttagcaagagctttgcaaaggacagtagttgcatcattccatagcctcattttatttgtgggggaaactaaggcactgtagagatcagttacttgggtaatgccacaaggctgcaataaatcataacatatacttcatctcacaataattattgaaacatattagtcggtttttgtatcttagttaatattttatatacactacattatgtgatcccgatgactacaataaagtaggtaccacttcacagaggaagaaacatgattaagcaatgtgccccaaatcaggcatcagacagaagaatgtatttgaatcaagaatctttatctgttagttgtgtcctggtgggaagatgactacaaactattttcagtttggaagttggatctttggtacatgcagtcagattggatcttttcacaatcaacaaaatgctatgtgcttgatgtccaatgcaggcttttgctatctgtattactattggtaacccaccagagatgaccactcagacatagtttataggcagttgaaagtctatattccaactggctgggaccacacccagctactccaggatctaggtgtgaccccaagtgtttagagcacatgagttttgaaggcaaattccatgtattggcatctagctcagcagctgcttgtggccgttgtggaagcaagtagtttaacagaagcttagataagcatgtagctggagagattccacacaaacaggcagttgaacagaaggtgtttaagttagctaggacatcctgacctttgttttgtagagttggattattttcattgggattattcatcaaagagacccaattctagttaaacctgaaatggtctcagcaagaatacaagatggagaaacctttccattgtcttgccctgtcacattatctttattatctctctctgccttgtcccatctgtccaaatgaatatgtagacaccaatgacacaccaaagacttcctcctagctcatcctccatagcatcaagcctggttggacaggtattatatagttttccaggtccttggctgcaaatatgtgggtctctaccagtcccaggtagcatcctctacaagatttcctctctcttcctccctctctctctctctcccttcctccctccctctctccctccctctctctctctgtctctctgtctgtctctgtctctctctgtctttgtctgtctgtctgtctgtctgtctctctctctctctctctctctcttcatttctttctttcactagaaggcctcttagtgaacatatgtgaagcatgacaaaggcttgtttacaaaccgtttgagtcagctttaaagctacctgcttcttatagattcatttctgttttctgttggcatgagaaattctgtgccgttgagggctacagatgagatgaaagttttataggcaatactccccatagatgcagagattacactgaatgccttgttctttttaacacccattcacatgatgctgagacaactgtaatgtgttcatctgctgcccttgaccctgctgcttttgcctctccctcatctgccagccgtgtgcattgttccactcctgagagtgcctgctggtttgcacttgattcatgtcttatatcatcaactctattctatgatcctgacttcactaaacatttggcttccctttccatgcaatgtattgctgcctgttaaatgtgcagtttggtacttttgaaatatctgcatgtaaaaactgttcttgaggaggcagtcagtagtagttttcaccttcttacttcaatcacatctccaccactagtgatttattcttctgtctgttcttttctctagccctctggcttatttgtttctgccttaaggagttttcaaacatcagtgcatcaaaatcatttggaagacttattgaaatccaaatttttttatctcactaaagttttcaatgtaacagtcttggttggtgcctatcttggttggtagaatgtttcctttgtaatcatgaagtcctggtttgatatccaattccacatagactcagacatggtcacacacacacacacacacacacacacctataatcccagtaatttcgaggaagagtctggaagatcagtttaaggtcatcctttgctacactgagagtttgaagccagtctgggggacatgagaccatgtctcaaaaatatttatttctgtggttgtagagatggctcggcagttaaaagaactgactttccattgtagagggcctgggttagatttctcatacccacatggcagttcacaatcatctgtaacattagtttcagaggatccaatgccctcttctaacagccacaggtaccaatcctgcacatggtacacagatacatatgcagacaaaacacccatatgtctagcatgaaataaaactttaaaaagagaattatttataacaaattttgatgtaatgctaatactttggttgacacggtatagtttgagaaccacagttctagaccaacattgttcatattaatcacctctttatttctgtggcttgttatgtagtccctttctgttggaatgttccaatgtgcaaagatggctagcatagctaagattcctcatcttttagggccacaggaaaaaagctctgaatgttccatcgccctccaagtcagtgtcactgaaaagttacaaactgaatgtactgtctagaatcaaaataaaggtctcgaacttatttccattgttcagcccactgtctaaatgtaagctgttcagctttctagaagtggccaggagaaaaaaaaactcagaaatataaaaagtaatctatttgaataagcaaaatcatttggctctcatactcatattccttgccgttattataatgaaaatatttctatttgtacatattggcagaagtaaaggattattgttgcagaatattcctttacactgtgtgaagatgtgtcacggagagtggtttaataaagggctggatggccaatagctagcgaggaagaggttaggcaggacttctggggacagaaaagactttgagaggaagaaaggcacagtggccagccagatgccaagggagtagaatgggcagtacagagtaaaaaggtaactaaaccatgtaaaagaatgcagatttcaaaatatgggttaatttaagtcataagcactacttaggagcaagcctgagctatggtggagctttcgtaattaataataagtctccaaatcatcatttgtgagctggctggcaggacagagaaagactcgttacagattattggtatttggatatgaatgtcttccaaaggcttctgttgtgcaggcttgcttagttcctgttatgtaacgataactctttccgcctgctgcctgagcctggctgccacaatcgggcccccaaacagcatacagagtcttatgttagttacaatgctgctagccaatgactaggatttctcataagctagctcagtcttaattatcaaccataactactaatctatatattttatagagacttatcttatctaggacgcaggccttatgtgtcctctcttcccagggctcacatggagacttccgtcattactacatttctcagaatcctccatgactcctagctccacctatcttgcttccctattggccaacagtgctttatttatcaaccaataagacaaacatacacagaaggacttcccccatcaatgttcagagcttggcctttgaagaagggaacctttaacataatcagtggattaattcatagatggattcataatgggaaggcttattaaactgttatagagactaagagatggagatgggttagagaaagtagctcactggagttgtactttgaaggctttatctgctccctgagccagtcctgtctctttctctgatttctgatgaccctttgctgtgtgggatttcttcctagtgttatgctttagcacctcaagcccacagcactggaaccagctagctgtgaagtgaaacttgtgaaactatggtccggaataatctttcccttctgaagttgttttgttcgggtattttacataccaatgagtaggtaacacaattatctcggtgtgtatctattcatgcactttgtgcattagttttaatggataaacacatatctaagaaggcttgaagctaatgtaatttataaagtacaaacctccagcactaaaagcattcttccagcacacaaatggaattttgggcccctgtgtattttctggcacattctaagtacaagctggaatttgattccctaaatgaatgttgaactacaatgtaaagctccctttcctatgtctgcctgttcataggccaacatcagaaaattatattacagaaaatggctaccaggtgtggccaaaaggggagaataataacatgtgctgaataaaggctagaagggagcaaagaaaggaaaggggaagactaatgatgaataccaagtatcctttgactgaagagattagactttcatatttggctgctgagctgcctcttaaacagtttccgaactgaagttctgagcaattttacctttggtttaattggatgcagtcttccaatgatacattattttgaaaacaccacaatctgctcactggcttctgtctttaatgttacccaaggcttcttccttttggacttttctgtgactactcttcttttaagttaatgaatagcttctgtgctatttcactgttttggataccatctcacacgtctgaatgtgggtgtttttgttgtctgtttacttgctttttagataaggccttactatgtcttccaggctgggctgtctcccaggctgggcttgaactctgcctgcacgcatccttgcacctctatcttaggaatgtctagggctgcttctgctaaccattacacccagtttacctgcacatgtgtgtgtttttccctcagcactcagccattcaatatcaaaaatatttctctttttagatttccaatctttgttattgtatcatggtaccaacatcttttccctcatccctggccatcattcagtattaaaatctcagactctatgatgagtaataaataatgttatgcattttccttagatgatttatttttcctatttacacttaaattcagctttttggagacttatttcttggttctcattaatctttacctcagtggttctcaatctgtgggtcgagaccccactggggtcaagagaccctttcacaggagtcacctaagaacatcagagaacacagatatttactttatgattcataaaagtagcaaaattacagttttgaagtagaaaaaacaaatactttgtggttgggggtcaccacagcatgtagaactatactaaagggtcccagcatcaggaaggttgagaaccactgctctccatgctattctttggtaactgtttttactcccatagcttcaaataatatttcttttccttttcttccccttgagacaggttctcactgtgttgccaggctggcattaagcctacagagaccagtctgcctctgttttctgagtagtaggattaaaagcatatgccactgtgcctggctcaagctaatcattttaatgactataaatcttcacccttttcttcaaatatcatctctttctcagaaattttttagaagcactgtacttaatttctaataaaatcttcatgaacatacctggcaggcatctgaaatgctgcttcttttctctataaaacttgacattctgttatttttacaaatgtatttctcctattagattcccagtctcatatttctactcttcctactacaggatattgaaatctcagaatctatccctttcgtcgtttatatcaggtctccaaattctgagaaacatctatattatttgttttttcccctttattttcttttctactgtcccagagcttggggtatttatgcctaggatgaaactacctaactgcctctggtatctaggaccaaccaatatagcagtttatctattaaccaataagattaaacgctacatgcatgtatgctgtttacattgattctctttccttaagatatattttctctttgtctagactccgttaggcaaatccatgtgaccacaaatgaagtgtaattgaaactttcattatttggacttttactatattttccccttagttattagtggtagattttatcttagttgatccttccagctccttatagccttcacagtcctggatatctgtcctgggtaatgtttctagagaacagcactcaagtttaacatgcacatttcccccactcaaaagactgtgacttttgaaagtggcatcctaacttaccttctcatctcagtttctgatttttttttttttgagataaggtttcatgtagcccaggctggcttcaaactccctgtgtagctgaggacagccttgaatttctgatcctcctgattctgcttcccacaagcagggattctagccatgtgcctccacatttatttttatctagttctgggcattgaacccagagccttgtgcatgttaggcaagcactctatggattggactgcatccccaaacctgcttcctcatttttcttaaacagaggtctctattgagtccatgaatatagaacaaattcaaaattcaggatcacatttcaagtctctctgacttggttccactgctcttccagctttatctctcactgcagcatctgtagaatactaacacagtccatattttttcttcatgctgctggtaatgctaattcctttgtcacaaacagtttcctctcattttaacatttggggtcatacacgtacctaggaggctagattctctctctacaaaagttgccagattcttagttcttttcttattgtatgacactataacattcttttataagtaattatgaatttgtcggttgccctgactagatagtaattccattgagaccattcccttatattcagcacattgccctggatatggatcattctcaacattcatttatatactattactgaattaaaatcacatatgtaaattctaatattctagataaaatcttattataattctacatggtagtaagcaagaaaaacaagtttgaaacaggaaaagcaatcgtctcataatttatatatcaaaccataggcccacatgcaggccggcaatgcaacaggaaaacatttttctgaggattttggaatcaagctcagcccagtaagcctttgaatttggccactaccgaagccaagcctcagaggcctttttattgtgtgaagcaacaacatgatgagggattaaaggatgaaaatgttgatgcaaatcagggttggttcatagagtttagaggcagggctgcctttaaaaaataagtgctgatggaatggcttgttagcctttctgttctcaaagcagcagaaggccaatgttacagatatatttgaaacaagaaagcatcaaatcaaatacagaggagcagtgtgtaaatatcctggtgtttgtttctaaggaaattatccatgagccaggagcaggggttcatgggattcatactgaaatacatttgaagctgaagtaggatgattgcaggtttgaagcaaatccaggctaaatagcaaaaccctgtctcaaaaaaaataaaaaacaaaacaaagaaacaaacaaagcaacatatcaatgctgacttggagacagtgcctacacaactcattaaagacagagaagctgagctagaaccctagaaccctcaccctatggactaatattcatggtactggaagggactctggtggatgatacctaatgagaaagataaacatcaatccagttacaaatccttccatctaatatgatgtcttgccggaaagatatgaaggtacaatagcgatgcaatgcttgtgggaataacgaataaagatctgatttgatttaaggttcactccatgaaagggaatccatatccaacactgcttgagtggctaagaacctgagactagataggccatggaacttggggaaaccaaatactactgttatgataaaagaatgtagcaataaaatgactcctaacaacatttttctatactcatagatagatcagtgtcttgcttttccatcatcagagaagcttccttcagcacaagatgagaacaaatatagagacttacagctaaaaaatgtgcagagagtgagagagcttggaacactcagccttaaatgggatgtctccatcaaatccctccactcagggatcatggaaccatgaaaaggcacaaagagtgtaagagccagaagggatggaggagaccaaggaaacaaggcctcctaaacatagcaggatgatgcacagaagaactcacagaaactggggcagcatacacacgacctgtgcagcagatgaagtcctggagctgagaggagatgtgggcacatttcccacccccatctctaaacagaaactatttctaatcgataaccacttgaaaatgaaaaattagttttcttcaattgaatttccctggtaaaacaagccactcttaagggaaggccccatgccctgcagtggatggtcaaagctaaatgaacgtgactcagtggcatctttgatggttcctagtctcataatatcttgtcggggcttttttcttcctttctctccctgtttttaagaaaatttaaattttatttttatttttagctgtggttttcctgagtgcgcaaaataattgggtctttatatctatatgtttttttttgttttttgttttttgttttttttgcatgccttttcttggactctcttccttatttgtattgctctattctaattagtttgtttttgctttgtcttatattttattattgtcccttagatgactgtttgttttctaatgatatacagaaaaggagtggatgtggattggagagcaagtggggaggagctgagcagagtagagggaaaggaaaccaaaatcagaatatattgtatgaaaaaaatctattttcaatacaagaaaaacaaaataaaatctaataaagccacaaatcacatgctgaattggagatggaggtgagttgtagagagagcacttgcctgtcatgtacaaaaccctaggttagatcccggcacaagaagaaaagggacagaagaaaactcacatgtaaatctttacaaagagggccataagacgccttatgggttaaaagggtaaaaaacatttcctaggcaaccctgaagacttgagttccaaccctgaatcacacacacacacacacacacacacacacacacacacactcacaataaataaaatttgaagttttatagtgttggtcttctgagtgaatttgatgctattgtagaagcacatgttaacttttaatatcttgaattagtagacttaaataaacaagagctaagtattcttagttatttattaggtaaaatataacataagataatataaatcagtctccagtttgtcttgcttactccatgtgcataaagtcctgagaggtgtaccgtatataatgtgcttcatacagtctttgtggtcatttctataaaatagcaaagatcaggtcttagataataatttttctgtcatatcattatttaggaaaactgaatcgcaaatctgcatttgccaggaagggaagaagccttttatttttgtcaggatgccagctcttgagctgtaaagaggcatatttgccactatgtgaacagcaagggaatggcttaaacaactggcttctctcaacatgtaagaaatgcatagataacaatgagtaaataagaatgagtgtgaggccaggtgttggtggcgcacgcctttaatcccagcactcgggaggcagaggcaggctccagagtgagtgccaggataggctccaaagctacacagagaaaccctgtctccggaaaaaaaaaaaaaaggatgttaaaataatgatgtgacagagtatatgaaacacaaataacctgttttaggctggcctagctattgcctgccagatataaataatattcttattgtttacatgtgttgtttagtttttatgtacttagtaattattttggacaggtcagaaaataaaccaccaaacacaagagacaatagtttttaattgcacaattgtagtcctgcttttacagtaagtatgctcatcttcaagagactgtttaccaatttcttaagggagtctaaattgagctgatcatcttggcgtgcatatggaatgtcaccacactggaggctccgtcaagataacaacatcaagaccactgctccacagtgggtctcggtctcaaaagaaaacaagctaaaagcaactgaaaacaagtcagcagttccaaacactaacaacaaaaccctacacttcccaaagtaaatatcctcatgaatactgtggtgtttctctcagccacatagattagcaaggaaacagaaagcttgccccactctgttcatccctacatctgtgctttaataacgtatagattggagggataccgttcatgatctgttaagagactcctggaaaacatcttggagctttggtgaatgtagagcagggaggtctgttctttgttaaaaagcattatatgtatatatcctgttcattcctgttaaaagttaaaggcttcgttttcaatatattgtttaaaaccacagggggcaagaatttgggaattcaccatccacttctcaccccctgcccccaagaaaaaattggcactgttgtcttctgggtaactttgtgtggatcagtcgtttccattatttgctttcattcccaaatctattaacatttatctccatgtaaatggccttagtagtgattagtgtttgtagttttgtcttgttgataagcttttcctccattgggaaccatcacccctctagtcagagaggatttcaggagtttggtggcttagctagtggtcctacagctgtaggttcaattcttatctcagctatccggaaatgtgacagggttttggagataagttttattttcctgtctgccttcatttcatagactttgtctgctttactagttcctttagaatcagtgattttttttcctacgtggtgcattgccagacccctcaacagactggtaatttgtttcctaatcccaatccctgtgactggactcctgttacatactacctgatcacatttctgtctgtctgttgccaaagttttgagactttaattttctggcctcatgctgagacatccactggtatacttccagagtctggctgcctgcctggctgcttgttacctgcagttacattctgtaatggtgtagcagtttatccaaactcttcctggtgatgccaggaccttctaagtcctcctgtcctgccataattactttctttagcttctgtaccttggtcagactctgcctgccaacatctggcacttgttgagatgatatctcccaacttaggtgtagtctttatttccttggggtagcattttgctaattgttatttatctgatattcctttcctttatttcctgtatagaatgtgtggtgaagtagggtttgttcctcctaaaagagtcttgggggcatttctgtatttcctctggggctgctcgagttccaggccttaggacttacttcatctagctttaggcagagaggagcagtgctgctacacctcatttcctcagggtgtggcagagaagctaagtggagtactagccaaaggagccagctggactttgctctgctgtgtattcgggatctgtgaagagttttatttatttatctatttatttccaaaagaaatccctactaaaggaaacatggttctgaaaaatcaggtttcaaagttgtctcaagtacctttgccaaaactcctcctaaaacactttatgttttataacttccttgctaaagatccttatcagcgaataccactgtgtcctacactccaatttgtttgcatactgggaaaaggttatgggctgactgcatttcccagtattattccgcacccatgttcttatgattccagcataggttcatcagcctttgaacatcgtccatcaagatttccaggctgatccacatgacgtattttccttgcttcctttctttgttttgccttttccaatctgatttctgattccaagttcagcagcgcaagcagctctcttagaaaacttcatctctttgaggcctaatttgtctcatcctttctctctagtacgttgttgtcttttgagtcagttcttccagttaggaagataattgtcctgccttcatgtctgtcttagtgtttctaatgctgtgatgaaacatcatgaccataaacaacttggagaggacaggctttatttcatcttatgattccaggtggatagagaagagatcatgcaatcagtgtaggaacctggaggcaggagttgatgaagagaccatagaagagagctgcttacttgctaggtccccacaggttgcttggcctgctttcttttatgttttagaattaaataatgactttttccagcttgttttgtgtgtgcactgcctccctcctctcctcccaccccctccctccaacctccccgctgccctcccccccccactccccctcatttgcttcacccagcaactgatggaaacagatgcagagacccacagccaaacattaggtcaagctctgggaatcctgcagaagaaagggaggaaggattgtaggacccagaggggccaaggacctcagaagaaaaaccagagaatcaactaacctggactcaagaattttaaagagatggaactgacaaccagggaacctgcctgagactgacctaggatctctgcatacatgttacagttgtgtagcttggtcttcttgtgggactctgaacagtgggggcagggcaggggctgtctcagactctgttacttgcttttgggccccttcctcatccttcctgctttcttatagaacccggtggtggcagctgggcccttccataacaaacactaattaagaaaatgcaccacaggtcaatctagtgggaacattttctcaattgaggtttccactttcaaaatgattctctagcttgtgtcaagattatatataactacccagcaaaaatgcttgttttctcctgtatccccttttctcattcttcgttcatttatttatttattcattcattcattcttttttgaacattagctcaaaccctagactagtcttaaacttgctgtttttgcagtaactgactttgtactcttttttctttcagtttctttttaaaatttttttgatttcattttacattccaaccacagctcttccacccacccctcctcctagccctctagcctactcccatccccctcacttccccccagcccactcccagtccactccttctcacagttaattattcccatgaggagtcaacatagtccagcacaatagcttggggcagggcccagcccctctcccatgctttaaggctgagcatggcatcccaccatggggagtgggctccaacaagctagctcatgtaccaggtttgtattgtggttgactgccagggggccctctggtagtccaagcttcacaagtgtctcctacatacagagggcctagtttggttccctggagtctccacagttgtgggtctagagttcaggagtttgcattagcttggttcagctgtgtctgtagatttctccatcatgatcttaacctcccttgtgcatatgttccctcctccctctcttcgactggaaacgcagagttcggcctagttcttggttgtggatctctgcgtctggttccatcaattactggatgagggctctaggatgatagttggggtattcatcaatttgattacagggataggccaatacaggcatcctctctactactgctatgagtcttagctgggatcctgcttgtggattcttgggagttaacctagcaccaggtttcttcctaagcccataatggatcttcctattaagatatccctttcgaaatgtccagagatctacaaggatgacatcaactaaccatctaagcaacagtggagaggctacattaaatgccctcccctgataatgagattgacaactaacttatatgccatcctatagccttcatccagcagctggtggaagtagaagcagacacccacaactaattactgaactgaactggaatccagttgcagagaaggagaagtgatgagcaaagggctcaagaccaggctggtgaaaaccacagaaacagctgacctgaacaagagggcctccagactgatcactgggaaaacagcatgggactgatccagaccccataaatgtgggtgtcagtgaggagacctcgtaaatatatggggcctcttgtagtagatcagtacttatccctagagtaggaatgaactttgggatagagggatactccctcagcctagacacactggggagggcctaggccctatcccgaaggatatgtcagactctgaagacccccctcccctggggagcagaaatggtattgggtaggtagggtgttagtgggggcaggggaggaggggagggagagggaacagggattgacatgtaaaacaatcttgtttctaatttaaataaaaaattaaaaaaaatgttttccccaaattggaaaaaaaagatatccctttcattgctcttatactgtatccctctctacctaggccatctcgttctctcctgttctcatccctcctcccccttatcccccagcccccaacttgccctgtagatctcctctaatttcccttcccagggtgatccatatgcccctcttagggtcctccttgttacctagcttctctggagctgtggattgtagcctggttaatctttgctttacatctaatatctatttatgagtgaatacgtaccatatttgtctttctgagtctggattacctcactgttggagaggatgtggagtcatgaggacattcctcccctgctggtgggagtgcaaacttatacagccattttggaaatcattattgtagtttctaagaaaattgggaatcaatctacctcaagacccagtgataccattcttggtcatgtcccaaagaaagtttatagcagcattgttcctaaaagccagaacctgcaaacaacctagatgcctctcaactgaagaatgaataaagaaaatgtggtacatctacataacggagaactactcagaggtaacaaatgatgacttcatggaattttcaggcaaatggaccaaactagaataaaccatcctgaatgaggtgactttgcactcttaatcttttgcctctacctctgaagtgttttgattaccacactgcatttgaccctttgttttcttgtttgttttctcaggtagattttagattgagtgatgaaggagatttttatatttagaaggttgctccattacaaatgtctgtgtacctcaaacaacactctagcaattatttaactggagaatatgtcaaaataatctgaaagcccaattgtttcattgatgaattttcttagcactttaatcttccaagtaagcagaagccaacttccacatattcaagcagacttagtcatacaaaaacattaaagtgaagtatttagtataaaatgctgtcttaagcatgactatccactggtttaatggcttcaacctttaagttttcaaccatatgtaatgtcgtggcaaagctatgagcactcactgaagctgggaagaccttttaccatgtgatttaaaaagttgactacttttcaatttaaaattctcataattggatctactaaaattcaatgccactggggacaaacaacagggaggagacattaccttgatgacttttgctgcattcaaatgccagtgacaatttaatctccagagtatttttattaggatagctatctttttggttaatgctctgacttcaaagttgtttcaaatttaagtgatcttgtttgaccattttctggaagccctgttatctatagtatatagtttttttttttttaaaaaagaaaacagaacaaaacaaaacaacaaaggatatctagagcttctctaggaagatatatatgacattatagcaggaggtatgacacctcttctctcccttgtttaactctgtgttgcatctagtttgatgttagccacataatttatgcttagcaaacacttgtttgcttttggtcatctgttgactcataaatatattttgctgtgaccttggagttattttctcgttctttttttctagtttgtgtttcctcgaatttttctatgaatggcagattgtttagatgaagataatggaggactttaaggtcaatcggaagaaagatacacatgagaaactagagggagagactggtctaaagtatacttttgatactctagttgatggggagagccacccttctttttttggcaccagaaaaaagactacgtcttttcctccacaagtctgtttgtgcgtcacaagaaggaaaaaaattaaaggaatgtaggtgaaatgagatcagccataagacagctgtttgctgaagccctaggttcacagttaagggacaaagtatccttgcctgaggctactgttttcttttttgtgtgttagtttccaagagagaccaatgaccctgattcctgcaaaaagaaaaaaaatggttgctgtgtgtgtctttgctttatactttgtttttcacattaaatagggaaaaatgctgaaaaacaaatgatgagacttaagacagggtctgaaataaccacaataaagccaaatgcaagtcccattaggaacatacttttccactttttgtagagattatagatcttttataggtggccaattggttagcaaatggagtttcgtcctgcctgaggacagcaaaaaccaacgttgcattcaaaacgtatcaattcagtttcaagtccataaatacatgtcatagagaaataattcatattacaaggcctttccctccctagctttttaaaaccacagtgatgtgtacaagtaggagccttcataattgttcagataacaatgttcaatcctgtttcttattttatttgtttggttttctgtgacaaggttttactaggtaactttggctgtcctggaacttgttatttagagtaggctgtcctcacagtcatggagatctgcctgcctctgcttgctcaatgtactattatgtcctgctgtgtctcctcttgcaacagtcctccaccttaggtgtttttcgtttgcttgttgaaattacagggtctttgcacatgttatcatcggttcctttgcctttgtggaatgctctctgtgcttgtttgtacagcaatgggtcaatacatttttgttaaatacttttctcagtaggctgagaagtccatgacgataaactacatttgtagtactagcttgctggtatttaatgtctttaagtagacttttaatagttaattcaaaccttatcttcttcaggaaggtgctcttccgcctctgacatatatactacataggttccccatcacctatttttgctccatgatgcaattcatttagcttgtttcttcagtagcctaaagggcagaaattaggtcagttttagccttccaacacaagtcactttttataccatctggcataaaaatgtttgccgaacagattattaagcaatgcttaaacttggtggcatctccctttgatccatacccacatttcttctagagggagtatgtgaaaatgttagccatatcattcattatgtttctgtagcacctattattattttttttactcagtatttcaggtagggtgacatttagataaattcaattatgtatgtgtgcaatgagtcaaagtcaaaatatacatcaaattccaagttgcgcatgagctttaagaaagcaaatgtatcttggagcttttgtccattgtatctgagagcacacactcctttgctgccgtccttggggaaatggctacttctggaacatagacatcttaccctcatgattaaaaagaaacagtgggcaaagaagatggtgggatttgagctcttttgagatatctaaaatcttttcactctgttgttcaagttacttgcgtcaccaaattcatcctaatgaatgctcactatattcatttggctccaaattcatttcagcataactaacttcaaattgaattatagaagaccaaaagaccccattgcccaaagttatcttggtcattaacagggttatggacatatttacggacttggtgtttaagctttattacaaatggcttccccagtactttgccctacatctgtgatggtttggtggttccttcagatgctgcttttggaagggctcttttggaaaagagtggggaaagctagttgctgaggatgaaatagtagggacctcgtttgggctgaggactatgtatgctgcttgctggtgctatataaaaacactagaagttgtctagggacttatcttttaaacaacactttgacatacacgatcttatttactcttcacaataaccctaaacctaaactagcttgggaaatcgaagatagaactcagctcaatagtaaagtgtaaagaggtgctttggttaaagagcctaatatcaccctaaggattacttggtgaggcactagtggctttaaccactaacagactgggaagaaagcaatgactatttctttggccacagtgcaatcatggcaacagaagcacccactctttccactttgacccatacaatctgtctaaggcaattaatcagaactcccagtggttttcctacacgttgccagttgccttactaattaaaccttcccacagagtgtagcaagagcacaccccctgagggccctctgactaaggaaggtatattgaccaacactagtgaaagttgagactcagttggcctcatcagtaaaatgcaccggagaattgtcctcactcagtttccctgtctctaaaatgggctctcctttatccgtctagactagttcccttccttttggtgctagtctatcaggaagtgaaatcagtgcttaaccaccacagaatgtcctctgtgaggctccagtcgccgctccgggcatgctcagtagcctggcccgctcagcaccaagagtaggaagaggcttttgcccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccttcttttcgggattccatttccctcccacctcttgtcagttgctgtttggcctcttaacacttggggtccagggcaggggaacctccctccgctccgtttcaaacacattggagccaactcgcagctaagtaaatcaagacaagcacgacataggttcccaggtccttcgactttgccagaaatccaaggaagaggcgcctgcgtgccttcccccccccctccacaccaccatgtgctcactcaagaaacatttcttcggaagcgcgtggttcgaggagagcgtgggagtggagcctacgggaggcccgctcccccaatatcccgctacagtgtttccacttgattgagaatgctcaaaagcagccctatacccttgatgtgactgacagccccgacagtgtagacaagtagtagttcatttcctgctgaaaggcaagacatctatggggcctggtgttcggttgggaaatactggggtttcttcagctcatcagttaaaagggttcctctttttgtaaactttctaatttcagtggcatgtggagaaaggggttacgagcacagattcagcacataaactttgcagcctctcatgagccctttaaagcagaagattcctagttcacatcccaagcacaagccacatgttgcatgtctatatttcatctgtaaagcaacaacttgattataatagaagagagagtgagactgtgtcatgcaactcaaaccatttcctgtggcatctagccatttggtctggacttacacttctcttttggctcctatttgctttcctattacagactgcccatatggggaaacaggggtcaaacatcaggacatacgaaggcttccattatgtgggaaaggacttccgctaggttaatcttacaaatttaaaatctcatcaattccatacaaacctgagaaagttatggaaattacttcttaatgtgccctgttattccagcctttctttacaaataaagaaactgagtcactttttttaacttgtctgtactatctatcacagttttaatgagtatctgcaccataatgaattcgaggaaacagttctgagtgtattgctagagtttaatgtatttagaattttttgtttgttttgttttttaggttctttctatatagtcctggctattctggaacttattatgtaggctaggctgaccttaaactcacagaaatcctcctactttggcctcttgagcatgtgaaccaccatttgcaaccaagtagtcgaagttttaatgaactgactttgaaattagtcagtttgtggtaagagagtgatctttcttcccccgcccccctacctgccccagtctagactactctgatcagtagtaaaaagtttaattgaaaagagaagttaaggaatagtttccatagtagttttatacatctagtaagaatcttccactttcaaggatactaaaggaaaaatgtttatctcaattaataagaacactgtggtaatattcttccttctctttggctgtttgtcctatttcatcttttatattttacttgatttgacaaggtaactagatagccatgagatagcatcactttcggttcccagctaacttcactgttccatagtgaacatagcttgatgcagtagctcaaatactggaaccctgagcataatactgacatgaattttcttccttcccccaagtatatttttgagctttgcatgatttctataagttaacatgtcatacacttataaaagcaggaatgcagtaaggcacatttttataaaaaagattttattatgtatacagtgttctacctgtatgtttgcctgcaggccagaagtgggcaccggatctcattatagatggttgtgaggcaccatgtggttgctgggaattgaactcaggtcctctgggagagcagccagtgctcttaacttctgagccatctcttcagccatgtaaggcacattttaagaccaaagagtttgaccaaacaatatgatttggtaaacttttcgaatgagttcacctgagatttttaacttaaagttttgcaaatagaaaactttagattttaaaatgtcaatgctctatattatgtatcactataataattcccaattatgagtgtgtgtataggagtcctgtatgataacaaaacagtcgtatggcaatagaaattgtttgtctgggttattgtgctgttaagggttcaaagctcttcaaaatatatgaaaaaatttgagtatgttcattttttttttggtttcttgccttctgttaagtttcttacaagcatccatgacttgcaggaaaaaaaagaactgtttcatttcaaaaggcagcaaaaaaggtgacagtagggtgattgaggactctgataaagggagaagagaaagcattggggacaaggaagagccatgcaagaaaaccctgatgcaataaaaagtttagatagcaatatctatatactgttcagccacaatggaagtttctgtcacattacaaaatttactggatcactgtagtctaatttttttaactatatgtcttgtgatacaattgcatctcttttagttgctcatggatttggaaaaaacaagaatatagggtgtatttcttttcagacaaagtgacatttatatcctcagcttattgatgtcagtgagaactttttcacattctccattcagaactgtaatgatttctgtttaaggttgtgtgagtcaaattttaacagatttcacctcagttatttttttcagataggtatcttcataatgagcgccccccccactttccatacatccatacatccatctgtctatcagggaaggtagttctttcaacaacacaagacattttaaatgatatattgctattagagttttggattttatgtaactttctggttaggcccagactgtaacatgctattaaccagcatgaatattagattaattagtaatttgatgtcaactgtggcttgtattttgttaaactgaataggagagaaagtgccctagagaagtgtaagggagaagctctatcttgtatctcacatatttaaagcaatgatttaaccattcagagaatgcaatgttgtggttagacagttcagttggtaaagtacttgcatgcaaatgtgaggactgagtttgatggccagtgatctggtataaagcctggtctggcggcactcattggttatcccagtgctgggggtaggagaagataggccgatcctaggagctcacaggccagccagcttagcctaaccaaagggggcccataatcctttgaaagagactctcaaaaaggaagtaccttctgataaatgaccccaagattgacttctggcttctacaaatatatgcctgtaccggcaaacacaagcaaacacagacacacacacacacacacacagacacacacacacacacacacacacacacacacacacacacacacgaacgaacgaacgacaagggagcgagagtgaggaggacatttttaaactgtatctaagacctccatcttccatcacaagatggtggatatagagtagtctgacactagttgaaacttttatatttttattttcttcttgtataatttctgaagttgttgcttttttcccccaactttttcatttgaattagaaacaggagtgttttagatgactttcccagttcccttctcccacccgtcctcccctatccccccaactaaaaccttatctgtcacatatcttttcagctccccctggatggtgaggccttccatagagtttcatcagagtctttcatatcctttggaatagggcctaggctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctcttcactggtccttctctgcatctgggtcccagttcagattggtgattagttatgggtgtctgcttctacttccaccagctgctggatgaaggcatataagtcagtcatcaatctcataatcaggggagggcatttaaggtagcttctcctctgttgctgagatagttagctggtgtcatctttgttgatgtccagacatttccctagtgcctgatttatggagatatcataatagttgttgctttctttagacagtgaaattaagttaataacttttgctgataggtgtgagaggtagaagaagccagaattagagtgtttaactgttaactaaaagtttactatactagcacactaatattctggttactgtataactgagaactgagtattggctatttttttgtaattgaactacgttttgattttcaatacgatgctttgagcttaatggttttatgtacagactttgattaccaagtattcaccataacttccatgtttggtgacaagaagtgctcacagtcaggctagggataatggtgcatatctgtatatccagcattcttgaagtaggaacatcttacatttgaggccagcctgggctatagggtgagacctcctcttcaaataatactcctagtcaagcgaagcagagaagggaggaagggagttaattatatgggggtgctataaaaatgttacagaggggcatttcagtcaaattggatttggatttttttaaggtttttctagacagagtttctctgtgtgtatccctggctgtcctggaacttgtactgtaaaccaggctggactataactcagagatttgcttgcctctgcctcccaagtgctgggattaaaggtgtatgccaccactgcccccaccaaattggatttttaaaactatctctttatgtattaaggtgcagcacctgctttcctgagtgctgcctctggggtattgatgtagagctcaccctgggtggtgaggatgggggtgaggtggggggctgaccaaccatgcaactacccaggcccagaaccagggctatgagttggcccaccccaacatccaccctatctatgatctgttggaggatgtgaaggggctggacctatggatccaaacctacaggatctaagatcttcctgatacagggcaacaacaggatatccaagaggagtcccagtgagggcccagtatagataatgcagcagaagccaaaccagaggcctggaaccagaccagtgactcattgcaatgaacacttgcaagtaaagatatatgggtttactgaatgactcactgggccacactgcagcttccacaatgagtttttttttcttaaattttattatatttttgggtggagctcgcaaggacagagggcagaaatgaagggagggggagatgaatgggatcaagattcatgatgtgaaagccacagagaataactgaaaagttaaaaaagagaccggcttatagtagtacacatgtgcaccaaggcttgaacacagctttgatttaagaaggggagaaaggcattctagataaaaaaaaatggcagcatatacaaaggtagagagatgacgaaatatgctgataaagaatgttcaactagagaggactggctggattaaccaaaaaaaaaaaaaaaaaagacccagcagaaacaaaaagaagttatatttatttgtggatctggccacaacgggatgggctctaggtcacagtagatttttgtgtctcatgttggagtttcgactttttttctaaaggtccgactaagttgttggggagattaaaatgctaaggttccctggttaggtatgtctttcagaaagaaatttagacctgtggaaaaattcctggaaagggatgctggagtggaggcagaaggtccgtgaggaggagcagagtcgtgtggtggagtttgccatttagagtcctggattctagttgctgctcatgtatgccctgcatcggaatctctttattcctgtaatccccatttcatctcgctcccgacaccaccctggatagtctcaccaaattggaagcatttttctcatttgtctgtaatgaattgcagtgcttttatagcctagccgctacctctgtgctctctttcttcctttaagccttcactggttgtttcatcttggtgaggaaggggttctgccttctgaacatttggctgccataagtttcagtgttatatactgattttgctttacagagattttcaagtgcttcacgacatggctcctcttttttgtttattcttataaatcagccatcaattattaactagggatttttttctctataatcagatatattgggagttacatcgttgaaaagagacaataacaacaataaaccaaacaaaaacaaaaaagaaaagtggtggttctttgtttttctttttgagatgaggtttcatttattccaggctggccttgaacccttatatagcttaggatgatcttgaacttcttattcttctgcctttacttcagctgctgagattacatgcttgcatgctgtatctggtttatgtggtgccaaggctgaggactcaacccaggacttcctatgtgctaggcaagcactctataaattgatcaatatcccaagcccctaactgttatcttttatgtgctatttttttgtttgtatgtacatgtgtatgttatcaaatgaactttcccgtccattcttctgtttcttcttagtcctttttttagagccttgtctgatcttgaattcactaagtagctcctgagctggccaatactggatcctgtcttcctccatatcccaaatgcatggattatggtctgagcctccattcctggttcctctgtcttttctctgagttagaatttcaaacaacttcttcagggtcatgagaaactccctcctccccttgtttgtttagattcttctgatgtcagagctggagctcccatgcagagagatagtactgatattacaaagtaccaagtaacagtttgctgttgttactaggaggcttcacaacaagctaaaaatgatacagattgtagagtcaaaaattctgggttccattgtcttttctgtcttttatttgcttgtgttctctggtgagcattaataccagaaatttcagcactttgattaatgtctgccctacagagatatggtttcttgcctaaaatgcttgtttgatttttgagacagggtcttgcaattctgttgcccgggctatcttttaactcccgacctctcaggtgattctcttgtcacaatccccttagtagctggaactacaaaagcatgccatcttgtgtgtctgatttgccagacaacatggcttagataaaatacagtaaacattaagaacacatttaggaaattctataaagttatagcaatatatattactgttagccccttatatcacccgaatcaaatgtggttatggaactggggcatagcgccacggtagagtgcttgccttgctttcatgaggacctgggctcaatccttgctctcctctccagttccctttgtttttgcagcattgcacatcctgtccatttactaatcatcctttcttctgagtgactgtagatgtgactggaacttttattcactcattttttaaattttaggttcatttattttatattatgtgtatgagtgttttagcttgcatatatgtgtgtgcaccacatatgtgcctggtgtgtgtacaggtcagaaggtcgtatcaagtcccctggaactggaatttcttagtgttttgaaaccaccatgtgggtgctgggaaacaaactgaggtccttgcaagggcaataagcgcttccaaccactgagtgatctctctatcccacactctgaatttttaaagaaaatgtctactgttttctttgaactgatcaatttcaggcatttgaatattttttaaattcagtaggaatgtatgacatactgtcttgtcagggagcttagtgatcttgtgcaaataaggaaactgagtcattcaggtgctatggggactgacttagagataagtttaaaagctatcacctctattgtagaagttatctatagcactgagtcattatgcttcagggactcttaaaagtaaaaagttattcagtctctcacttcttttgttcctttttgaacaatttataattataatcctccttagatttcactgtaagtactaagaactttgccagtagcagtatgtcatgtaagtgaaatcttactcatttctaacctgttcttaaaaaacactgtaaataccagtatgctctgaaaaagtatatagtaatgtatgctaatttatatgaatcagcacatctggttaatatattacctggtagccttagcattgaaatggttattattgaagatccagatttctctcattccttctgccagatttgagaagtatgtcatattatttttttcctgaagacagaaaaggttacatgacataataacatagttgtaatctttcagcctaacttggcctcatatgagggaaacccattgtggaagacagctcacaattggtgcatgtatatgttgatatgtattttcacatggttatttattgtgaacctcaggataggaagaaatatattctctccaagttaaaacttattaccccatcaggctgaatctgatttaccttcaaatgatatactttgaccatagttttaaacagaaccttaactgaatctcaatacttgctttgaaaggggtggcctagggaagaagacattggtgccattttgggggaaataatgcagaaaacacaatttttaactcattaccatttgcactgtctttgatttagtgaagatttttactgaattgctctgggaagagggtgctccattgctaccaaaaccttgagtaaattggcttcccatttctatcatttggtctctataaagtggtgcttctcataagtgagaagcttctaattgattcatacaagctaggtgcaagtcaaacacagcattaggaagaaattactcacaatagccattgactcaattactagtaattgtgatgcttgcctaaaggatgggaggatttgattacagtcctttatttttgagacagaatatcatatagcccaagctggcctcaaactttctgtgtagttgagggtacctctggacttctcaacctcctgcctctgcctcctgattgctggaactaccaacatgtgccaataatacacaatttacgagacaataggaattaagcctatgaattaattcatgaaagggaggcaaacactattatcacctgagctactgcctcagcccacaatcattttttaaagttattggttgtgctgtgatagttgtttaaagatagccatatgttttgataaattcaacattttgaggaattttaattgtacacctaatttgttggtcttaagagaaaagtaaaactaagttgaaatattttaaaacatagcaaaactactaaaaagaggatgtaatatggtgacctaccatttatttattactcagacagagcagttggttctctagaatttctaaatttactctatcggtcctttgttttttctttgctagaggattttaattcacactccagatatcttttcatttaactcctacagacttcagtctgcatctctaaaattgctgagttcttaaaaacaatcactatgccactgtcccatctttaaaatagtaatacaatgcttggtgttgtctagtgttgaaacccataatcaagtatcctcaattacctcaaaattaatttgattcttaatctaatgtattcataattaatgtatatagcaccaaactccttagataaatatacctttaaataatgttaaaaacttcttcaaagttactctacataaataggttcacctttgtctataattctgtaaaattaactatgagagttatctgtacaagtgtaagtagactggaatagctactctgtaccatagaaaatagattaaatttagacttctgacttcactttttttcattttgtgattgtgaagtggagtttatgtggaagaatttttttgccagaagtgctatagatagctgggcaaatgggaaaatattcttgaattctatacatataaaagatgcataaaattatttgacaacatgcacacacaataacatgtttagattactacttccattttttttttgtttttttagacagggttcctctgtgtagccctggctgtcatggaactcactcagctgcccttaaactcacagagatctgcctgcttctgcctcccgagtgctgggaataaaggtgtgtgcaccaacaccccccagtttgctaactgtacttttattaccaaataattgccaatttgtcaccttagataactttctttgttaattagtcacattgacatactctaagtgtgcatctagttgaccaggccagtgaatctttgccagaaactcagaattatcattgttttaaaccaggttatattaatgaggtgattgtgctgtggatgggtggagtggatcaacttgggaaaatggattctccaaagactgttttaagaaattgtataaccagtactctgtagataccagcttggtgctattacagagctgagaggcaattgggtgtataatttctctaacttcatgaacttttaaataacttcattcttgtaatctatgtctccttcttgactgagcagttactgactgagtcaagtgggtgattgtcctctaaacacataaatgagtgataattgttggggctccttagatagctggctttgtctccgtttgttttgcttaagggaaggaaagttctggatgtgttgttttatgtgctttgaaattaatcactggtaaaatctgaaatgtttaatagcatattaagcttgcccgagctatttaggaaggttctatctgtagatagcaaggcactgtgcttttatatcttggcctttaataacatgtatggtataatagtgatgtgtaattatgtagggttgggccctacacaatggtatcagaccatggagatcacactatttgccaacatatgccagacataaggctctgtcttcctggagtatttttctgtttcatacagacatctcatgtgggttgggtgatgatttaaaaccaaattgatttcatttttatacttgcaaggaaattcagcaagcacagggaatggttgaatatctcatatagagtaggtgtttttttaaattattctttatatgtaattatgcatatttgtttgtttgtatgtgcatgagtatattggatccctggagatggatttataggtacttgtgagctgccaggtgtggtgctaagagccaaacttgggtcctctggaagactagtaagctgtcttaacggctgagccacctctccagtcttctagaataggtatatttcagttgtcattcatttgtaataagcatattatgtgtatatctatgtaatataatgtacccgactgcttttggttttgaattctgaaatcctcatagatggatgactgtgtccttggggttcagcaaggctctgctctttctctactcctcgcagtgattttcttgacattattttttttcagagagctttagatagtcatggattgtatggataagactgtacttttttgaagtttgtaatgtaacttgcatgtatattcatttacatcacctatgatacaaggcgagaacatacagaatgttaagatgggattggcagagacagagcttcttataatatgctatgcagtctggtacctttcattatgaaatcaatgtttttcagaagagtccctgtgtatataaaacatttagcatgaaaataacctttcttaggttgcactcacagattgtttgtcattggcactgcagtagtttacatttctccccctttggttgaataactaatggtctttaaatggaagaataagtttagtaggccaagaaaaaaaaaagtctggattttatccatgttgggcagctcagattatttgtgtatttgtgttactaaaacagagtgtacctatgttctgtgatctctaaattcttgactcttcagtacagcctaaagttgctctatcaaactgttttcagatgctcttgtgagatctaaaccattcatttttatataagctgagttggcctgagactacatcctaaattctaagtagctgtgtctctatatcaaatgaaatgagggtttagttgtaactgaaagtagtgattgcacagggctgtaagccaggtttccacacttgtccttccagttctgctatagctaattatggatcgagttatattattgtattacattgcagatcctggcttttaactccctccgtcctttaaaataatgttattacttgaatgttactaatcccgaagatcatattccttgtcatgtttattagttttttgaagactatcaatgtagaagaattgtcattgaatgttaaatcacttgttgaatgtctcagatatttctgtaatagcatttctcattcatgcccattaccagccatgttgccatgaactagtggaaactccatttttgtcttaacatacagtacaagttttcaagacctcgaactatattttatagtagttaaaagtacttcctatgctagtaagagttgaactgagctaagtaggatatgtgtgtcatcttattgtttaaaaagcttgtttctgactatttgaggagatttctaagacatgaattaactttaaaatgtatttatggtcatatcattttttctatagtttttgctgtcagtttttttctctgtacaacaaaggggtagaaataaatgatctgaatgggcttcgttcagattctacatattaaggatcaaagattattaagaactttaatgaatctgccttaacacaaatgcattatatctagattttagttacattgaaagtgggaattatgaaagatcactgtttaggctgaatattaaaaactgaatatctcatctttatagttttgtttctagaatctgacttattctatctagtgaaggctatagcaacactcttttatcagtatacttccctttagagagtgttagcttagttctaggtcattctaggcattgagacatttctgtagttcattaaccaaataaatgctcaggctattgagagataattcagtgatagtcaacatcatgcctcttgttatgtttctgggtttgttgcatctatttgtgaagagccatacaaagaaggcttggggaatggtttatcagtttggaccagtgcccttgcagaggacccaagaggacccaagtttcatgcctagcatccatatctggtggcctgtaactccagaaatccagtgcctgtttgagcacttggactcatgtgcacgtgccacccccatgcttatagttaaaaataaatctttaagaattatacaaagtgtgagattttatactgtgtacccagtgttccaatttcacagatcattgacgaatacctaagacttcttgatcagagacaaagaatactatcactgaaaaagtaatagcaacatgtcaacacaatactcgggttcaccttaatcttaagtcccatagggtagatttggatgatgggtacaggaagtgagttgtactatagcagaggaacacttgagggatttgtcactttaatagtgacaagcacacagcctgctctttgctgggattgggagatgttacctcattctgaaaaccacttcttacaaacaaagccctgggaaatagcctgtataaaatcccagcagcacctttcagtcttgacacacagacctgtaatgtacaaggatggtctaggattgatggcggattgtctccctctgaatattaacacatttcaccctgacagacatcggtttgtagggaacaagaaaggctcagagcagctcagtaacttgcctgagactctgcaacagtgaacttggcatttaggcccaatgtgattataaaaatctatgttttaacccatcatttttctatactgcctaagagcctaaacctccgggttgctctaaattaaccagaagaccttgcagtaccgtggactggtgatgtttgggacctggcccacatttgcaccatgtttatgtataatttagaagacagagttcaggggccatttgtttcaatgttactgaaaatcccaagttaaaattctttgaattgctgccatgaaatagtggggaagatatgtgaccatttgcaaaagtgccatgggcacagaagggatatgactgtggattttaaggctacacgagcacagttcttaaaaatagcagtcttggtagtttgacctttattacataatttctgagtcacctcaaggcttgctgtgctttagcactgccattgatggtgatacattctctttctttctccccatttatacttgagtgctttctaacagaatacatggcaaggcccattgcattcttcactcttctttcccctccccattctctgtttgtttgtgaacttttctgtgaggcaaaactgccttggaaaactaatgctggctcctattacacaagtacacgatatgcattgtttcttgattagggaagtgccaagaaccacctaccttctcctgctgcttcctgtgtctgctttgcctaaagattggctgctataaaagtgtggtacaggcagccaaatgcaatctttttttaattagtttccagaaagtgttgtgacaaactattttagcgttggtgtgtgcctagtaagaggccttagtcgtgggcttaaaagccaaataattgcgagtgcctaatgtagtttgggctctacttctttcagctttaagcatcatccctccaaaaagaaaaagagtgcctttaatttaaaaaaaactataataggtaaattcgatcatgaatagttcactgtatgcctggagcctgcagtcaagctatttcacacttatgatcactattagaaattaatgagacataatgtttatgcatttttatgggataccctatggtaatttgacacttactaatgttagtgagctaaaatttccatgttggttcttttcattgaactttttaccatgcttgagagagaaggatagacatgatgagagggctagtaattaagcagatgaagaattttattgtttttagttttcaagtttttccatccctcaaaatccatgtacacagttacttttccattgctgtgataaaataccactgtcaaggcaccttctagaatacagtttatttgggcttatggtcgtaggaagataagagtccatcatggcatgaagacatggcatcaagcagcatgcatgtagtctgtttgaagcaggaagctgggagctcacaccttccaatgtaagcaggaagtagagagagcaagctagaagaggcctgaggttttaactttctaagaccatcctcagtgacatacttgtcccatcaaagtcatactgtgccaagctacgaccataagcccaaatgatcggcctaatttagactctggctagctcttttaacttaaagtaaactgtttttcttgctctgcctttttgccttgtggcttttaacctggcttcttgccctggttgtgttcccctcattctctcccctcttctcttgttcatttttagcctggatttcttctcatatttattctctatgcctggcagccccacctagtcattctctgcctagttattgccattcagctctcccttagacaaattaggtgccttaagtgggcaaggtgaaacaaatgcagcatgaacaaaagtgacacatccttacacacttacagcattattctgcagcataaacaaatatagcacaccctcaccttgctaaaataatattccacagcaacatagtgctcaaactcccataaatagtgcaccaagtaagtgttcaaatgctggagaccaggtgtgtggcagggttggggcatggaatccaattcaaaccacctcaccatgttagttctggttgctcatattctccttttatttttgacttcaaatccagaaagctttaacctgtgttaaggacaagcacataagaaagggatttgaactcnnnnnnnnnnnnnnnnnnnnnnnnnnnnnnnnnnnnnnnaggtgtgcctgttttaattcccaggaagcatttaataatttctggagacatttttagagtttagagttgggagacagtgctgctagtatacagtgtgtagcagctgtgaagatcctttgtatcctacagtgcataggacatgtcctctacacaaagaggtactcagccccaaatgtcaaggttgagacagattgaagggctggaagaccttgctttagatctgactttttctttatttagtgtggaaaaactcctgttggtagctagatagtctccttttgccatttgtcctctgccctgtattgagctagggtcagggcatccatgttttcaaggaagtaccagtcatatcattggccctcacaacttgtattcttatcttcttccttcctgctaatccaagcctgctggactggactattaccagctttgtgttatgaattgtacttcttatcacttatcacatttctgacaactaaggaaaatgtgtattctcttcctacggggtttaaaaggtgattttcattttgcttattgcttgagcccttgccagctcttgatgctgcacatacttaatgcttcatctatatggcttttaattattgaattgggatgtggtcttgccatgttgctcaggcttcctttgagctcacaatcttcctgcttcagcccaagtgctgggattaattgtgggtgcgaccacacctggtgatctgtgtgtattttctactctgtgacattggcttctctggtaccttctgcttctccacttgttaaattccaaagtcctagtcctttctctcgtctcacagattttccctgttggtcatctctccacaccaattaaggaaacagaatgcctccccaaataacacctgcctggagctgatgccagacttcagttgccgtccacatctctgttggagactgtgccatggcaagccaagggctgtggtttggttcgactgcacacggattaaaagggaaaatactttatgacagtgttcattttaatattctactctgcaagaaacatcaaacccaactgtcccctcatgtggtatttgtcaagtttaccctctgaagttgaggtttacccttgccacacttatcagccgacagtatttctttgttagtagttaccgactgacctttatgattctgttccagtttaatcaaggttaacttccctatttgaccattgaaagtcactttcaactttgtgctcagctcaccagaactgaggctattttgtatttgaggataatattaggcacctaactctaattatcatccttttctgtttttccttcatttaattaagccatgtactgcatcatcccacgtatttgcaataacctctcctcttgcacatttattcttttcttgtggagtctaagtattttccatccatttcttcatgtaatcattaaactgattttacctgcttacagatgacatgatcactttctttgctttcaacctacaatttcattttgcagcccacacagtcttactaaccatggtgctcattataaatgcatgctacaatgtatagtcattccatggacatcatctccttgctatgtatgaggcctcaggctgagggcctaagtacagttacaaacaggtcttactcttgagaaacttgtggcctattgagaaaagagagaggtgactgtaaagtcgtaatgtaaataataaataggtatgatgagtagtgtgctgtttgcagtgccacatagtgtgcccaatagagactggagagcctcttcagatggtatgtttgatctgggtcccggagcacgaagaatagtgtggtcagattttctgggccttttccccaaacattcaatttgtagatatgcctggttatttttactactgacaacttgcttaggcaagctgctcagttggaagaattctacctttgaaattcttcttgttcaataattaatcaaatgtcataaatgttttataggagcccacctcagcattaagataagtaagcattattagggctaagataagcaatttctggctgctatgtacacagaattggagaatatggtgttctaaacacatggtacaggatggattgtggttcagtgcagatgcaggggtaaaggtgtttgggaacacagatgagtttcactttaaatggaaaatagcatggagggctttctgggaagatatggataaaaagcttcttaaaaagtatggagattgttttttaacaagtagtagagcgaggaaaagcatttccttcagcgagaacagtatgtgtgtcatagtcagcatgggcttacaaataggaaggcattgtagagtggatggcttacgcacaacagaatttagtttatacagctctggaggctggaaatcgaggatcaggatgtcatggataggttctgttgagggtcctcttgtgggttacacactgttactttcttgtggtactctcacatggctgagagctcagtgatctcttgtccaatccttactgtcattcaaaggccccagaaactttctaataccattacaccagaggggacattatttccatctgaatcttcaggaaaaactttcagcatacaaggcaaaattgcaagggcgctaagaatgaggacatgtttgagcaaagatgcaggatttcagggaggctgggatatgtgtatgagagtagctgtttatcaagatggggggattgtggctcaaccacagtgagcatcagatgctcacgcaaacactttgcacttcttcctgtaacctgcatagcatttgagcaagtgagtagggggagtaggacagtgtaattgaagctgattggagcttataatcagaccttactcgagttttggtaattggaaatatcatgaagtctaaactcttgttaaaactttgtggtaattgccttgtttgcagtgtaaatatagagtgtccattaattttgatacccattggaatgttttaatttgacagatttgaacctgtgaaattaaagacacaccataaatagcatgcattttgatgacttagttttgtagcaacttaattggccctttctcccacctcgctcctctgtagatctgttcctctcaagtttgcattgtcctaagtcaagctcttgttatttctctcctacaaacaggtactggcttaaaggtcacctaacttacatcacaggatttgtgctgtcaaaccaaatatgtaatgttttggctggattatagcctgtctttgaaatattccaagagaagcacaagatttgtgacatatgtaactgggtaaaatctagcttcactaaagtacttctattgtcatgtgtggaccacctaccacaaaataagctaatttggaaacagttatggcaaagcaatcttagcactgccctttactaagatacattgtcggcttagttttattactacaacttttatgatgagataattagtaattcgattcacatatgaatttgagataagaccaggtgaatagaaattggtccacaattgtatatatctgcgttatcaagcaaatatgtgcttatgtctagttcttatacaaacctacttgaaacatgagtcatactatagttgtggtggctattgttcagttgcttggaacattcgactgaagtgtgtatgtgtgtttatatgtgcgtaaatgtaggcttttgaggtttatctggtgtttccttaaaaggaaactcttttatttttcattttaatgggatgaatggttgtttggtgtttcagtctagctgaaagcaagtgttgcagtccttgatacaggactcactttgtgcctgacagctttctcatgtgagaaatgtgattcttgctaaatctcttctaagcttcccaggcacaaagcatattactgtaaacgaagaggacaggaacttcctgagttataaatacataaaatacatagccatatgaaaggcccttgtggaggggctcccctggtatgttgagccaaaaatactgtctggcctgttcttccccctcttcttactgatgttgccttgggaattggaagctcaataatgactcagagtggtttctgttttgtttctttctcagggacagccatatgtggtgccatgaatactatgcttcttaggaatgtctctcccagtcaggaccatatgacttcataccacagagttacaactgtcagtcaggagcatttcctgtgttaacctcttctcctattttgcttactaggatcgtacacttttcccatagatagcacgatagtatataatatctatcagtttccaaatgctatcttgagcttttaaagttaggaatgaaacactggtatttgttaggaagaaattgacgttagtagacagaataaaagtatgcgtcagcacttagtaagtgacttatgaatggctgggatttatacacaggaagggttaataatatgggacaaaataggctaggaactgagtcactaagaacgtcttcctgttcctttatgtgtgtgtgtgtgtgtgtgtgttcatgtgtgagactctcacacttgccaaggggcaaatattcatttagaattgcaaaaaaaaaaaaaaaacactttagcattcaggaaaccatggattttagtatgtacaggttcagaacttccacatatatcgggcttaaataaaagtttaagacatgggtctgtttcattttaaggaagtatttgctaccaggacacaataagttaataaacaaaatacaattgatttgtagaacactatcttaaatttcagtgctaattatcactacactgttgttttctaatgtccagtacattgaacaaagccatttttaaatagtactaattgggttcatatatttcttgaagatgtgtttatgaatgaacactgctgtttagagttgaaacaagtttaatattaagttgtatttccctaggcatatgttggatgagaacaatgaaagtattttgaaggcattagaaatatagttcccatttcctttaatgtcctcataccttttcatctagatttctctttatgcagatttgttaacagtcattgaaccattttgcttcaaagtcaccaggaaagctagctaaaaaatgtagattctagagcagcatgaatctaatgaaccagaattcagtagtgcgggcccccaagaatctgcattaataatctgcctaggtgattctgtactatacagtgcgacatccactgatgtcttagacggtttgcaaaatggtagtcctgcaagtcatttctagctcacagatttggtttgtttgactttcagtgttgactttaaagttttgcaatctttaagaattgggagttcacgtacaaaccaaatttctcggttctcttgagtcatcagaacatgtttacagtaatggctccatgtttcttcctgggttgtagtaatccactccatacaaatgaaatctgtgaggggggcatgtgctctagtgtttaacactctccccaccccctaacctgcatgtcagcctaagtcagttaactgatacttatttctctacagctgacccacatcatacatactcagaatttttatgcattcaggtcttcagctgcaggatccatatatttcaaatagtgaggagaaatgtttgcaaagaggtgagataggtggttggaaatataagagaagttagagtcctagagaaatgagcctccgatgctgggcactgagcctcttgagggggaaaaagaagagtatttgggaatgaacagtgttagtgattgactgagtttggggtaggaactggatgggagtctgaagaacagtgccatgtcctgcacagctccagggacagacctgactagggcagcaagagaatgaagacagataacacagacacacaggaaagcccgggtaggtggtttggtctctctgatggaaaaaccacagcatcctggaagctcagtgtgtttattacatgcagttgaagagagaagagggcttattgcacacagccggacaaggaggtggagttactacatacagttaagcaaggggccagggtttatgacacacaactaaatcaaggatgacaagtttagctaatctcagtgggagtagtctctgtaggggagcagatttcagattataaatatctgaggggagaaagctgtggtggacactttctgctcacactatcaatatctatacatggaccacggtaaggctttgccagccctctgggcctcaccccaggggttggagaggctttgccattcccataggtctgaggctgtgggttccttggtatggcccatggctgtgtctgtgtcaacagcacacacccttcaacacttggctcatgcaaggctttttcttctccctacaaacaggcacggtataatgttgggaggtgaagttgatgaaagacacaggacagtaggtggctgtgagacatcactgctcggtactgagatgttgcttgctgtggagggtggatgctcttctgcgttggagaagttgattcctggatggagtatatgagaatctcctgaagatatgtatgaattgaaaaagtgtgctaaaaaacctctactgtcttttttaatgcaagcaggagaaagaaaaatatctactcaattgtagctggcaagaatagacagaaaacagtgtgtcctctaccttaagctaactagggcagagatacatacagagtccctgtgtggaggtgtttgcaatttccctccaaaggggttatagattagcaaagattggcaattgcagtaggacaccatgatgacacagtgatttaataagagcagcttctttctggcaaatctgaagtttatcttctctttccctttatcttttctgcatttcaaatgctgctctgtgtgtattctttaatctgcagactctgggagcatgctgtattgtaagaagtgtttgccagactttttttttgtttctgtttttatctgcaagaaattgtttctttgggaacatgttctgaatggaggttgctttcccagggtagcagcacccccttttcgaatcctacttaatctacattgcagattagctgctttattaatagcatcagcctgatctgtggaagcagacgtgtgccatatggtataggaacaaagaaaaagtccctttctttctgctagattctgggctgaccctaatctatattttcaaatcagtcggtttatctttgtgcttctctaactcttctttcgtatcatggtgctctctgtttagaggctgctcctcttgctgtgactcccactccaacaacttgctacttcttcattgtccccagttacatggccatttcttctttccaaactcttcatctctgtgtagtcgcttaactcttaattatgaggaaagaacttggttattttaaaaatcaccttttgtggtatatggacataaatgcaggaaaatatcaatatgcataaaacgtaaaataaaattaaaacatctatatcgagacagtttttatgtagaataatctactcagtgacacattttctgttcatgcatctaatcgaggttggctttttttcttttctttttccaggtagggtttctctgtgtaatagccttggctgtcctggaactcactttgtagaccagagtggcctcaaactcaccgagatctgcctgtttcttaattgtgtttcctttggcttcctcagcccactgtatcttcaacatgatttatctgatgtttaattcactttgttgctgttttattttatttttgtgaatttcatatacaattcatgatggctaagtttgcttgtcaagttgacacatttgggaagaggtaaccacaattaaggaattggctttattggattgcctgtgggtatgtttatgaggcatgttttttctccagatgatagaaaaagaccagcccaatgaatgtgatgaataccatctctcaaaagctagctgagcatttcagatgagcaagccagtaagcagcactcctttatggtctctgtttcaattctttcctcctgcattagctcctcaattatagaaagaaaccctgtcctccctaagttgctttgaattgtgatgtttattactgcatagaaagaattttatataggaaagatatattatataaaatatatattatataaattannnnnnnnnnnnnnnnnnnnnnnnnnnnnnnnnnnnnnnnnnnnnnnnnnnnnnnnnnnnnnnnnnnnnnnnnntctgtttttgatattgtctattgacttccttctctgatagaagaggattaatctccctcaccacccttccttcctgttcttaccatcacaatacaattattactatttttagtttctgtgtaagagatcttcgatctttgtttgtgtaatgtgtactttatttgagacaatgaagataaatgtgagtccacctagatattttataattgcccctttgcactctatccttcttctgtatttaccaaaaggaaaaaagggaggagtcctgattttgcagtgtttccccatctccttatgctgaccaccctggtctggctagcctgtatgagaatggtaggcatgcgtgtatatgtgtatgtcgtgtgtatctgtgggtgtgcatatttacaagtttacacaagcaattgtgtacccagggcaaagattcgtatgtatttcggactttttgcgtgtgagaagagatagtaagggtcgacctggagtaatcaaaagcctgaacttgtccatactccgtgtaattattcttcagtttaaacactgttcctttaccttgatggacacgcattctcagcatttgcaatcactggtttttgtagcagtgtctaacttaaattctgaccttaaaggttctgtttattttttaaaagactttttttagaacagcaattttaggtttgtagcaaaatcaaagcgcaaggagttggtacataacttcagccttcacagggtacacagccttccttcctatgagcatcctatgccagtgtggggactttgttgcagtccaggaacctacttcagttttagctaaattgggtagaggactgcagttgctggatcatcctatgagtgtatttgagttttgtagggatttactaaaatacctttcgaggtggctgtatcaaggattgtgtatgctctgcgtctagtatttctttttcatatgtaatttccaatcattattatctggagagatgcctcagttattaagaatattcactgttccttcagaggaacccagattcagttcctagcaccaacatagtggctcacaacccatctgtaactccagtcccaggggatcctacattctcttctgacttccacaggcaccaggcatgcacatggtatatacacatatatgtagnnnnnnnnnnnnnnnnnnnnnnnnnnntatatatatatatatatatatatatatatatattctctttatagtttttacaaaatattgtgtgttattctattttagagggaggaaaggttttagatatggtcttactatgtagcctttgctggcttagacaccctgtgtagcccaggttggtactgaacttgactttatcttcatgtctcagccccctgaatgctgaggtatacatggtatacaccacttcattggctctgtgtataactctttaatatctattcttccactagttgatagggtctctctctttctttttttttgttaaatgctttcttaaagcatgccccatctttcattttctcagctcagtgttttgtctccaatatctgaaacagtgtgtggcattttcgcaagtatttctgaaattttattatatgtatgaatgagtgagctgatcaatcgataaaccaataaacttgatgaatgttctctttgccatttgatgaataattatgttgtggcttggtaagtttgtttgcttgaagactttaacatagaagacagaagaacaactaggtaaaatcatttggaacttgttaggaaatgggacaaaaatgttctccaaatgccatcttctgtaggtaaatttctctctctgtcttgctgtctttctctctgtgtatatgtgcatatatttgtatgtatttaagtattaaaattatatattcttaatttaattattttgttgtggttattgacttatcaaggaaaatactactttttctctgtccttctgtttctgtttctgtgtgatagtttggatgtgtgtgagtaggctcacctgtgtgtgtgagtgtgctcacctgtgtgtgtgtgtgtgtgtgtgtgtgtgtgtgtgtgtgttgtatgcatacatatgtgtcatgtcatgcaccttctattgcagtccatcctatttgtttgagacagggtctgttacttaatctggagtttactgtgtcatctagcctgactggccagcaagctccagggatccacctgtcaaccccacccccagcactggtattataggcctgcacttctatgcttggatttacatggttattagggctctaaacttagttcctcatgtttgtatggcaagtactttactcactgaggtatttactcagacaattctttctttggctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgcgaagatctggatatggtttctgataatcacgtatatatgtgtgtatgtaagtatgtatatttggagacaggttctcactatgtaacagtaactgatctggaactctatgtaagccagactggctccaactcacagagatctacttgcctccatctcctgagtgtcatgcttaagtatgtatcccaccatgacttactgataaattttatcatgtagaaaaaaatctagaccacatagtatttattcagactattcatttttgtggaacacaatagcgttgcagttgagcagttgacagtgaaccttagaacaaagactttcaatttaaggtaaatattaacttatgatgcgaggtatcattagtgtcacatggagttgaaagtgatagtctacagacagttactgctaaacttcactgtttttttgttttgggcaggttctcactatgtaataaaataccctgaccaatgcaacttatacaagaaagcatttaatttgaggaacctcatggtggcaggaacagctgagagcttatatctcactgtggaaattggaggtagagagagcgaactgggaatagtgcaggagtcttttgagacctcagagcccttccctagtgacacatatcgtccaacaagcccgcacctctcagtccttcccaaacaggtccagcaactgggaaccaagcatttaaaaatgtgagtctctgggaaccattttcatgcaaaccactataccatttaactggctggtgtagaacttgcaccaggctggcttcacaatcacagagatctgcctgtctctgctgcaaatgcggagattaaaggtatgcagtacctcaactggctaaactttattctctaaagaaaaattttctacgatttatttattttatgcgtatcggtgttttgcctaaccctacatattcatatgctccacatgggtgtctggtgcccatggaggtttaaagaaggtattggatcctttcagactcgcaatacagatggttatgagccaccatgtgggcgctgaaaatcagtgctcttaaccactgaaccatctctcccgccttaaactttaatctttatgactgaattagacatgttcttccatggtaatattcgttagatggtgaaaatttttcttctgtcagcattggcaatagtagccatagtcaaataggaagtggaacacacacacacaagatggaatgtgatgttctaccttactcttgttcttgcttcaagcttcagcgacctagaggagagtatttgcaagaaattgttcaagtaattaagaaaaagtctcccgtgtttccctattgatttaaaaagattaggatttgagggattaactactatccagtgagtacttatgcatagcccaaagtaggagtgttataatagaggatggtttacaaatcggatgaaaataagatgtttcctctttttcactttgtgtcattttaacaaatgttttctcttgtgacattgctctaaaaccaaaagatcaacctaaggggcttatctatttggagttttctcatttacagtgggtcacctatacaacactttcgttttgttagggcataaaaatctatattagtattttgctaaaacaaggaatgcaactcagtacagttagagattataaaaaattaacccatatattaactgcaaatatgtccaatcagtatccccagtaaagtctagatataaatactttcatatgtaatatgagaaagccacttccatcacactctgcccccttggatagttttaaaatttgagagggaacaagtgatgtgaatttgtatattctagtgcattaaaagttaatccttgtaaatggaaattgttgttgtttattagataccacaaaaactgacatacaataaaccaaaaatatttaagaagagcataatgctggcttttgcatatgtgcaaaactgtctccatagtcaaggcagtaaacatatgccccaggcttagatatgctatgcccatgataaatcctccaacctctattttccctttcatgtaccaagaatcagcagtttgcagttttctcaggactttggaagtttctgtgtacttgatttttagtaaaatacagtaataaaacctggttacaatattcttccttttaatcttaattatttgacttatcttttcaaagaactgttttacatttttcctacagtggttttattttcactcaatttttctgtttcttttgatgtttttgtttgcctaaggtggcaactataggtctttgagaacttaattttatgatgaagagatcaattgctctaaatccttcctagtgtttgtgtggcatcctgcagttctggtatactctgattttattgccacttagtttcaaatttctcgtttgtattcatctttgatttatcagttatttattagaattgttttatttttataaatattttgggattttccagaagtatattatgtatgtgtcatgaacatacttggtgccacaagtgggcatcagatcttctagaatagtggttcatgacttgtgggacatgacccctttgggggccaaacaacctttcacaacggttgcctaagataattggcagctattcatattatgattcataacaataacaaaattataattgtgaagttacaacaaaatgattctatggatggggtcaccacaaatacagaactatcttaaaggatttcagcattaggaaggtcgggaatactgtcctagaacttgagctcatgatagttttgagccatcatgtgagtgctggcaagggaatataggtcctctgcaagagcaacatatgctcttaactcctgagccacccctgtggcccccaaatcttttgattttcatttctttttttctagtttttatttaaatttgaaacaagttggttttacatgtcaatcccagttccctctacctcccctcctcccctgccccccactaaaccctatcccatcccctttcagctccccagggagggtgaggccttccacgggggatcttcacagtctgtcacatcatttggagcagggcctagaccctcccccatgtgactaggctgagagagtatccctctgtgtggaatgtgctcccaaagttcattcatatactagggatacatactcatctactaccagagtccccatagagtgcccaggcctcctaattgacacccatgttcatggggtctggatcagtcctatgcttgtttcccagatgtcagtctcgtgtccatgagctcccccttgttcaggtcagctgtttctgtgggtttcactagcctggtcttgacccctttgctcatcactccttcctttctgcaactggattccacgagttcaattcagtgtttatctttgggtgtctgcttctgcttccatcagctactggatgaaggcttatgtttgtctttttgtgactgggttacctagctcagaatggtttcttctagttccatccatttgccttaaaatttcaagattccattgttttttcccactgagtagtactctattgtgtaaatgtaccacattttctgtattcattcttcagttgaggggcatctaggctgactccaggttctggctattacaaataatgctactatgaacatagttgaacagatagatgcccttgtatgaatgtacatcttttgggtttatgcctaagagtgaaattgctggatcttgtggtagactgattcccattttcctgaggaatcaccatactgattttcaaagtggctgtacaagttggcaatcccaccagcagtggaggagtgttccccattctccacatcctctctagcataaactgtcattggtgtttctggttttagccattctgacaggagtaagatggtatctcagagttgtttttttaattctttaattactactcatatttacatatccatccccccattcccttgacctcccatcctcccatgttccccacaaacacccaatccaccctcaaatgctccccagggatagtgaggccctccaagggggaccttcaaagtctatcacatcatttgggggagggcgtaggccctctttgctgtatctgggctgcaaaagtatccctcctttgctcctccctccttcctctgcacaacctgattccagtagtatggttcagtgcttagctgtgggtgtctgtttctgcttcaaacagctactgaatgaaggctctaggaaaggtagacatcaatctcattataggggaagggcatcaatggcatcctctccattctaatacatttcttttgtggccagtgaatacactttctgtaacttaaatactttgacattcattgaggttgtaatttctagtaaatgaaccatacacacttgagaggggtacatattgctttgtattgagagttcaagttctctgtcttcttgctttctggctcccaattcctactaactttcttcctccatgttctatcagttgttgagagagaagcttaatatttttgagtgctatcgtggctttgtctgtttcatttacaggaataaatgatcagaattattaattctgattcctgattagttggcccctatatcattatgggattttttttctttcattccaggtagtgttttgttgttgaggctacagtgtctgacacaactacaatgacctttttataagtattatagtaaggtttatagtctttcatcttttacataccagtccctttaatgctttttccttgtcattaggttttagcaatttgattacaatgagctttggtttagcattctctgctggcctgcattgtgctttttggattagttggttatatattttctttttaatcaaattgtataaattatggtcgatgtaccttttaattatctttgatcttcttgtctttttttgctccttgggattttatttgtttattttttggcatgcttaaagtttcattttcatttgtatggtttgtgtttcatcttatcaagtttctgtagcacatgttttctggtggccatctctaatgtctatttgccattagtcctttaactgaattttttgcttagacattgggattttcctctctagtccccctcccatctattgatctacttaaaattcccaacatgtgggacaagttaaaaatttttaatgcttagtctactaattttaatatctggagcagatttcattgattttcttttctcattatagatctactttaccacaaatatggccattttttggtgcattaatatttattaaaacttttgttttacagataaaaatttatagtatatatttttgttatgtataaaattatatattcacatattatatatgcatatataggttaattgttttctaagacaagttctcactatgtagttctggttagtctggaactcactatgtagactaggctatcctcaaacttgctgcttctgttgacaatctagggttaagggataatggtccacgacttggtgattttcactttttgagacagggccttgctgtgtagctcaggctggccttgaacttgtggccatcttctgacttgtctccctagagtttgagttgcaggtgtgagccaccacatacaaattggattgacaatctttaaatggatgccagattttgtgtatttttccttgtgaagtgctagtcattttttgattcctttaattttcatattcctagatttttgccttatatacatgtgccgatagtatgttgctgagtagcagggtagattttccacaaatctatgggttgttttgttttgtctgcatggctccctcttttctattactgtttgttgtatgtactatcttttaaagatcactgtcctatgctgtctattgtccattaggtgagaaatcatttcatgaatatttacttctgggccaggagaggtgtcttggtgtgtaaaggctatggctgccaagcctgaacaatcccctgttttgaagcatgagttcaatccccaggacccacatggaagaaggagaaaacccggttctgcaagttttcctttgatctccacacaaataccatggcaaacatgtgcccccccacacacaattgtatatgtatatgtacatatacaatcaatagaatgtaataacatttttgaaaaaagtatgtctgttttatgtatttttcttttgaatatgcatgttagttgtatttgtatgttaaatcctatagtactaggagttatagatctgttttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagaactgaagatggaatgtaaaatggaacttaaaaaataaataaattattttaaaactgttcaccaagactttctagcattcctgtttaggcttcagcataatctttgggattcacctgaaaattggcagctcaataatgtccatacaggccacgtggcaaactcaccttattttgctcagtagatacttggcgattgtttgattgttttctttacaaaacttaaggtttattcatacaaactgtatacatgtatcttttcccagatttcaaaatagtttttcttacaaattttactctcttgggtcataaaatggtatctattcctttgtatttgctgattgcaatactctcttcttgtaaaaatatttccagtctttagttcctttaggcacaggaacacacttcaaggctaccagtaaatgcctaaagcaacagacagtggtcaacaacttaggtccagtaaggttaactaataataaagtagaataattatatcagcatactacaatataagttgtgtgaatgtattctttcttgaaagtgttaaggtgaatgttagcattttgttgctacagttgagcagaaactctggaagcagaagtacagatggggtgggattactgcagagcacagaaacaggaagtcagtcctgacaacccgtttctagtttatccttttagtaagcatgttttgctgaaccccataatgtttgagatgttttcacaatggatcattgtagaaaactcatatgtaactctaagactttcaaacatacttcagtttgcttagattatgttgactgtgtggctttaagctagaccattctcattcgtcatgctggctgtgagaagagaaggcagaagaaaatccaaatcactgttcagtaagaggaaatgttatgtttatgctggatgagtcacatcaacatggattttggcagaaaagtttctatcagtttgacaggttttactcctggctaatttacttcctgagaacttgcaatgaactactcggttacagatggctgtttctgaagtaatccttcctgatttgctttacatttcagtattttccctgtggaaactctacaaagattaaactatatagtatgtagactctagaagacattttagttttttttttaattcttacagattacttcattttgttacagatttatttttatgggttcttgatcaaattgataaaatgactttaatacaacaatccagaaggaagagctaggatccatttattaccatctgaaaaaaatgtcaggaaagtgtttgagcagctgagtgggtgagggagagggtcttttggaagaagagtatggaccaccaaggtgtgagcagaagcaggatccgaagagaaactagaaaggggtaaaaggaaaagttttaccccttttaccccctttacatctacttttgatgtagaactcagaaaacagagagcaattaagatctgtaagcaactgcatagcaagtgggaatctttggagagaaagggaggaggcagagagaaaaagagacacagagacaacaaaagacagagacacagagagaaaaacatgctgagcagagcatcaagataagtagccgtaggatttgggcttgattccaaagagaaatagggttaaagaaaagttagactcttcctattagaggtcagaaaagtaagcaggcttaggagtcaaggtctccaagcatcaccatggatgcagagatgtctaggttgtgtaagtacatatcccattaatcccatagttatttcttccattttatttacatatcttcagggagtgctttcctgactagatgattgataagtcaagttggatgaattcttaggggaaatgactactgtgtctttgtaatcttaacaatgatttggctagtttagaatgtctcaagaacccaaaaccccaaaactaagcccccacaaaagaatttcatctctccacccattataagagctagaactcagatctcagttttttgttcattgtcctggaactcaaagcttagatgaggctgtcctctaactcacagagatctgccactctcaagcactgggattaaaggtattcccaacttcctcatttaaaagtaatggaaaggtctgggtcagaaaataaaaccaacagcagttttacacaagctaagttcataggaagcaatcttctaggcatgcgacctttgtgctctatagcccttgcttgaattctgaaatcggctatgtaaatgttgtaagacagtagggtgggaacttacatgagtttccttctaagcaaggaatctagtaactgttccggtgctgatgagtttccgtctgtgcagtcaagagttgcactatataccatactatggtatttgctatgctttttgtgatggtgtgtttttggctgacatggtgatgttgtatacaggccagggaatgttacccaaggtggtttgatttaacttctttgtgcatatgttcactatccacaagtagaggtagtccctacattacagatgtactttaggaattaaattagagccctaacaataatgcctggtacccagtacttagtgacccttaattctcagtacccgtactgctgctgtttgcctctttaggtttcactaactttcctccaccctccatttgagcatgcaaattaaaaataaatagcattccctgttattgcccttcagattttttataacatcagcgattctcattccttcattctttccttttcttcattctgtcttgtacattgtcttttttgatccgtctcccttcatctcctgtttcacttcctttgctccctacgtttcttctatcctccactggatttatttgactttttgcattgaaactgggcagtaagaaaactaggccaagtctaaattgctgaatattgttttgtgggtgagacatttagaacaattgaaaaagaaccttaggtatgcggttatgtactgtggaggtgatgtgtcattattgatcaatatggagggccatctttaacccatttatggagcatattccaaagtataagactcagttctaacttgaaatccctactttaaagttggaagttatatactctaataaatattgtagtaaaatgtgaaccagggtgttggggttaataaaaggttgttttgtggtattttatgccctctttaatgccttcgccaaagcactggtccttgtcagctactgatgattgacgccacatttcttaaagttttaagaaactgctacttcttcaaagtctaagttacacattccaggtgggtattgtctgtagctttgggtctacatgtagtattgtttctgtatttcatgtgaaaaagtgcttaatttagtatgttcaattactgtattaaaaagggaagagcacattttagtattttcctaagataaatgctcaccattttaagtagcagtgggcttgtatatagtttatgaaattttagatcttacaaggtcaatggatatctgaaaatacagcagccttttaacttggtggatcaaatttatacttaagctcttgaaagagttcactctaagtactcttgaggcagtttttataaaggcatttagatcccaggatatttcctttaatagaaggggtgcattgccccgtttctcatttcagctactcaaggtcctagatttggagtgtgtcttcttctattcgctttctgaatactttgacttgaaataagtggccagttgtttttcttctgtctccttgtggaccattgttagtgcacccaaccttgcctgtaatgaagaaaagcatttttataacctgattctaattcatcgtttttcatagataatgttccaaaggacatcatagttggatctccttcggtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgttgtgtgtgtgtgtgtgtgtgtgtgtgtgtgtgtgtgtgtgtgtgtgtgtgtgtgtgcaataatatgaagttgacctgtgaatttaaccatcatttgggagcttggttctgtaggaaaatacagcgatagaactacaacaaatctcatggctataaacagcttatgtatgtggaggatttctgtagtatttattgattatggctattaaattagtcattttatatagagtaagtattccatattagaaactagaattataatggtgagaagtcaatttaggtattttgtaaaattcttggctatccctgtctttctggcatattaatttggggccaaaactcaagataacacagcaagagaaattctgtaaatgttgaagcacatttatattttcatttcagtacactgactgttaattattctatcagttgtatgacatttaagttcaaccttctagttcctaattggccaaactgttatcagtccaaattatttggcattgaagaaaataagaaagtctacagaagctattaaaataagattagaacttttcaaatttatcctggagaagttagactttctcttgcattaaaagctctctctctctctctctctctctctctctcacacacacacacacacacacagagagagagagagagagagagagagagagagagagagagagagtactattagcaagtttaatgtggattaagtgctaggtgcaaatatatgatacacatccctgttaaagcttgcttttctggttgaaatcctttgttggcatcggtaatgttcaagaattatggaaggggttaatggactcttcatattttctggctttatctaaactgtgttcaatatattgataaacaaccccactgttctaaagtctagggggcaaggaagaagagtggtgagttttcagcctgaatatctttccactaaagcatttaagtgtttcacagtattaaaaatactgaagtcatttgatttgttccataaatgtgtaagtgttatcactttggttctgaagttttacagacaaagggatgtgcaggtcattgctttttattttatacaatgactagactacatatgatgccttgaaattcaggtatagttgctgttttattagctgttattatctttctatatgcaaacatccaaatttgtgaagagttcattttgacaagcacaagtttagaagaaatttgtgacctgtatgagtaaacactaattcaattgttgtttgcctaatataataacatgtccaaaatgaaaactatctggtaattctctatgatggaatttgtaaatcatagtagtttaagtgacatttttggtatatgctgtttattattttgacagtttctcttggtagctcagaagtgaatgccttaagcaaattaaaactgagttaaaaattgaaaataaattcagaagtaagactcagtgttagacaaatgtgtttaacagagctaccactattgagttaagaatctgtagcctgtcatgagaaaaatcaaggataaatatttgtatacatttttaaaatactgaattcttgcaaaactttttttagccttctgaaaattgaattacttttggctatcatatcatcatattttcctcaagcttcttagttttaaaatatttggcaatgtattgttctgaggttggttttctaagattctctttttaaattcttgtgtgagtctgaaaaggctgcctggctttctgggtactgaagaggtctgcttttagatggaaaacatggctttgagttgcacctttgaatttgtgtttcccaagggctaaaaacctgaactgaacaaacagacttttagacttgactcattcctgaattgtggattgttaggaaattcagaaatatcacctaaaagtactagtaatgacattaacttaaattgttggttgaattttatgcattctccctataaaattaggtttaataataacatattcaaaattcaggtataattttcagttttaggcaatttatactcttgaagctttgaaggagtaaatcattttgttttgtcagattaatttttcagctatatcggaaaactaaatgatgtggttatttataaaagcttcttgaaggagatgcatggcaagtcgttgtaaggtgaagtatctagtagtagtaatcacagccatttagaggttatttgtgtgttgtaaagatagtaatcacaacagcatatatttaaattactctatttaatacaaacaacaatcatatgtctgggtacattgcttcaacaacaagggtaattttaaacaaaattacatatactaacagctttctctgttccgtttgctaccacctaatctgagctcttatcataacaattggatctcgttttctttccatcactgctccttttcccaggcccatttccatcagtcattacaaatctgaatgttcactcaattctagctactgtgtaaaatccccgaggataaggtgggaacaaataaggatgagagctagttgtgagtttgggtgggcttgtgtgtgcttgcaaatccagaattggggagagtgaggcacgggtattggattgtgtgtttgagacaagcttgagctgcacaggaagactgaaaaaaatgacagcagtaaaaaccacaaaaagaaccagagagagatatgggtagagatttatctataggcagagaggtggaagacagacttttagtcctgagcacattgagtttccagtatagcaaggaaggcaataaggaataattgtaatctgataattacaaaagggagaggtcagcaaccatgcgtcacttactataagagaacaataaccttagctaagagcagaaaggatgaatgggagatggccaactaaagatgaaagagcagtgatgtagaataaggcctattaagtctagcaaagaggccagggaaaggccaaggctgacaaacaagctcaagatttaaccaggagtgttatactaatccatacggtttactaaagtcttcaaaatgagatcgaggtttcagagtatggaatcttaatcatatggcttaaatgctaattaaaaatgctaatgcaaaatagaaaaataattctccatatcattattgtgggggtttaaatgaagcaacatatataaggctcttaccattatacctagattgaataaacactcagtagagggttgctgttacatacatagaaaagaccaagcttgctaattattgtgtctttgagtctttcctcagtcagttctgaatatcatagaatatcatctgaattgctaaaacctgtaaactctgaaaatggccttttataatttggctgtaaaacttggcctacttaaatctgcatgtagatggtatttttcctgtttggtagaacatccttgttttattgctgaacttgaatgcaattcagtatgctactgtgggtctttctgggtatattttgttatttgttgtacatggaaccatgtttctcaaaacttgaattatttggaattccaaaacagacctggttccaaaattccaaagaagactggatccacgccatgcaaatttagcttttttaaaatcatcacctctccaatatccttctgtgaatcaggaagtccttaggacccctcagggttgctaaatgttttgtagattaccgcttgtggttttcaagagtaactctaatctgaccagagtcacatcttgaaaatgtaatgcccttcctcttgaaccttttgtttcctaaggccactcctcccaagtcccctgaagcacagagtgctccctcttgtgtctgacttccttccctttcccccctttcatgactattcctacccagggattagtgtgtgagtcttagcagagtttctcacccacttcagaaatggttaaaccatttcttcctcttatacttaaattctttttgtccttaaaagaatttatccaccaaatatttgaataggtattaggtgccaatggttgttcaaagtgttaatgattagaaagctaagcagactctcaaaatctctgctgggagggaaattgtttgctagtaagtagaatgcaacatgtaaattgtgagcaagttcttacagatagcacacaatgctgtcttgattttagaggacaatgtggtagggaaggaaaagctgcataccttagagcatagtatttcgttattgtcttgtttttatgtggttagttatctaacttctggttagactgcacatgtcttaagggaggagtcatgtcttatacttctatataccgtacaatactggttgtttaataatgggtaactgcttaatgtttgctcaattcattcatccattggttaacagagcaggtaaaattttatttattaaacattgctccccatttggccaacacatcgatccaagtgtaatctaatgtactaattactgctttgaaagattggaatatctgtatttatgtaaggctagatttttctagtcttgttttttgttaaattcatagttcatgaaggaaaacccttcaggttgaattcttcctcctatctcagatttagtacatagcaaacaaatgtaatttctgtgcttgcagaagcagctcttcctataaaaagcttgattattcctgcaattgtttttgcttaatttagacattaagtggctttcactaattcattattaggagcttttgttgaacacctaagtgaccagcatacatttcctgaggtgcttattcaatggaagagactgttggattcccatactatagttattgccttaatggtcaagtttggtacatttcatttcacattgagctcatatcttgttaggacagacgaacaatactaatttaatacagtaccagtattttgcttcatgaagaaaactgaagctctggactttgatgttatatttgatctcctatatataaatattttattcttctacaacgaaagaacagcttgaggagcagatcccagaaggatttttttttgtcagaacaatgacagaaagaatttttatttgtagtagtaaaaattctggcagcttaaagtttgaatcttcaacttgacaatatttctgagatggcatgcttactgtaacaaatatagaaacatattttctacttaaatgaagaaatggatggttatagacattagccaccaaagtagggaagatatttggagcttaatgtcaataagttcatcttctcttctgttagggttttgacctttgaaagcagggccatgcctctttaaattttcagtgcttagcatgctgccagttcgcctagcatctattcataaatgctaattgtgatggaggacaatattgccaaacatgatgtgttctgttggaaaatgacccttatgttagaatgtagaagaaagaataattgagggtaattttaaatacaggcagtaaatatttccatgatgttgaaagctaaaatttattctcctgtcatcctagaagcaaacatctacgttgagtttgcttctaaaaatcagattatagataattttctccgtgaaataaatagatcagagagatactaaactaacacaatctccatgaaggatttcagtgattgctcagaaggttgattttgattactaggtattcaaatgacctggaattattttgattggttttgctagctttgaaagttcagagtatagaatcttaaaagttggaaggcagaactacttccttctatgacggctaccaatttggatagataggaattaggcagacacgccttgtagaggaatccaaccctgccgggtggattttggctctcttgctccccttcctcaaggtctctctaacttggaattatgttcagtctgtaccaaggtactcctttatctgaactcccacggcatttcccctttcccattttttttttgtgattgttctttcaatcctctgatcactaactaactagaacctatatagtagatgttcaaatatttgttatattgatttgaatgtgtctttctgtgttccattgccctggcccttttggagagcaagatacttaaagctgggtgaataattgaccattcatctttgttgtaatggccagcttattgattttctttaaaagagaaaaaagttgtcaaatacagtgattgagtttttgagttgacgatgagacttttgaattgcatccaatttagttgtccaatttctgtggtgctagactaattgcacaatgtttataaagcattgtatttccatgtaacattatccatgagagagttgactctttacattttgctgcttttgttaatttctgcctgattgagaaaattaaaacttaattttcttgcaataatgatcttttgtatggcaatcagaacttcaacattagagtttataagtaagttcaccatttcttgtattcttaaagggttgagactctagagcaatacttttataattagataatactataaaatactgcactgttatatttaatatagctcatcataaatgaagtttaataaactctgattgcttgactaatgcgtactttgattgcttcttcagagttgaatttaatgaaaatatatggtcactatacttattgatgtaatatgtactgtaatgaccattatcattagatttgcataataaaaccttaccaaaatgactttaatcagtgcttttaattcaagactgtgattccatttttggggggtcacttttttctttcgttttttttaattttttaattctatgtatatgtatagatctatactttgtacaaagaagtaagatacatctttacctccatggcctgtgggaaagatatttcagtctatataaagtaaattcagaaatgatttgagaactttttcttaaaaaccacttagaaatgaagtgtttgtctatttattttaaaataatgtttttctgtgctgagggcctaactcatagtctctcatacatattcggtgaatgctcaaccactgtattatactgcagacaggctttctttgtgtatcccttgctgtcctagaactcttgctatgcacatccggctggactcaacctcaagagattcacctgcttctgcctccagaatgctgggattagaggtgtgcaccaccatggttggttgtatgaaggtgtactttaatacaataattttaaaatgtgtttttaatatcagttaatatgtggaccagaaggtagagagcacagggtaggctcgctctcacatcttttctggagagggatgccacggtggttcttgactattatctgtgtaatttgttccaaaataaaacagctatttatcgtttatcttgggtctagtgaactcattaataccctaccttcactgattatataatattcttacaaaaaagagaaagatcagttcatatgaacatgattgctttaaacttgccccaaaacagctctttacagttctttgaacttcctgtttggtgtcgttttttgactgatgttcagtcatgtggcagaaatcatttattttctattgatgaccatttgtgacttatactatgatttcagcacattttcgtatacagtgatgaaaaatcacaatttctgaaactcaggtactttgtgtctgctaaacattttcctctttagcataccatggttatttccctcacacaatttaacggaaagttttaaatattattatatttaggaaatatgccacttgtcaagtcaaaattataactactttttattttttttatgtgcatatgcatgtatatgtttgtgtgattgtctgatgtgtgtgtgcaggtgtctgcaggatcagaaaaggtgttggctcttctgtagctggagttataggagaacctcctgatgtgggtgctgggtaccaaacttggatcttctacaagagtagtatgtgttattaactgctgagccttttttctagctcttgaaagcaaatattttagaaaataaccatgttacagtaaatgcgcccatttatatagaatgtatttgtgtagtggaataaaatttataaatcaagaaatcaagagcagagtgttttttctttatggctctctatcataagtaattgagataattttttaagtgtatctaatttgctttctcccttggggtgctctatcattcttgaaaatacgtattagggagaaattcttcaagaataaaatagagcagagtcgttatccagttttattttaccagggttccacatttggtttgccagtagtcaaaatttaaatttaagaggcacctagaaatagaaatagaaatttagaaatgtccttctaaaatgaatattccaggtcaatggatgtgcaaaagtacaaacaggacatcataggaatgcactacacaaaagatttcagtttttgtattatgtagtacaggggtcagaagggaagaagtagaaggtggcctggggccaagtcattcagagcttgaatgcctttgggttattagtccttacagtagcatgaggcattaaatatttataaaatggaatatgagagtcattcataatcatattgagccttagtgtaccaagtattgttttaggcatcagaaacagagccccaaactagacagagaagaaatcatgtccttatacagctcatattatagtgagcagaagagatactaaatggttggggctgtaagctcagtggaaaaacgattgcttagcatgtacaaagccatgggttacatccccagcactagagaaaacaaagcaaaagccaacagaaaatgaataacaatatattgtagattggtatattagattttatttgaagaatgaaaaaaaaacacaagggaatgtggggattaggcccatattattcctataacagtattaccagagtaggcctcactgagaaaaaaatcattgctaggaggattaaggagcaagttttacagataacagaaatgaatgttgcaggcagagggaagagtgaattcctgtgggtgattgcttttcttgggagcagtgaggtggttagtgtgaatgaagctagttgaatgaaggggaagcagtaagaaatgaggtcatgggtcttgtagtcatcgtaatgactctgaattgcattggaaaggaaaatagagtcattgcaggtttgaacttaggagtgacatgactttggttttcacagtataatgttgtctgcccttttcaaaactcactgtaagagagcaaagctagaataagggagacaagataggcggttactaaggaaatctgggtaagaactgatggtggcttgaagtagacttttagtgtgtgtgtgtgtgtgtgtgtgtgtgtgtgtgtgtgtgtgtactgaacagttattctttagggcattggaaatgaagaatgatgatatgtggaggtctttaacatagaccaatggaatacagtggtaccattaacacaaatggtacactcttatttgtaaaattagttcttttgcttggattatcttaaattccacccaactttaactgtccatagtatgtggtttattgtgaacaaaaagaatatcaactcaaaatcagagaattgtcagaagattccagattcttcctgtcaaaccaaatgaaaagatagctagcatttcaatttttcttgtgtttgtctccactgattaaattgtcaacatgtgttcaattgagatacagatctgaagcatttctggcatatatgtaccttaacttagggaatttgactaaagcaaatcatttttcttctaatttatattcttcctttggagatatagaagtttccaatcataactttataaccccaatggaatggaagaaaaggaaagcagaagttgtttaaggagttatgtaatctatctcagaaacccagatggacaggctcatgtcagatgttagcagggtcacttcaggtctgtaattgtgctttactaggaatcaactttatcaccatgcatgaaggttttctgtaacccaccataaaaactcaaaacgaaatggtttgtgcataaacttctaaggtgaattaatcttttagagattgatttagttttgatataatctccatttttatcttttgtgcttatggatgatgcattcgtgtgggcgcctgtgtctgtgtgggcacatacatgtgtgtatgtttgtggacacatgcatgtgtctatgtgtgtgtatctgtgtgtatacatgcattctagagcatgttatggatgaagggaggtcagagaacatatatttgggtatttctgggcccacacctctttatcttgtttgctgcatggttagttggcctactagttatcacgggttctcctgtcactgcctgtcattttatcgttagagtactgggataatagatgcaaaggactgcaaagtggctttcaaacttaggttttcacatttgtttagtgagcgcttggcatactaagctatcttccaaccccctcttttcttttttcaaggcaataaagactggttgtggtttatgatgatttagtacagggattagaagtttaaactcctgacagaatcaaagaattcaacatacaaaaaaaaaattctacgcatgcactnnnnnnnnnnnnnnnnnnnnnnnnnatttgccacagctgttctggggaaaggttatctttaatagcacagagaggataataaaaattgtaggcaatttcctgagatttttgagaccaagcagttttgacttattgaaaactcacaatgaaattctctgcagtgaaagcactgtattttacttagtaaaaatacatgccaacatccatgaccatgtaaaatatactttattcagcttcttctgtaagaaacaagattatgaaacaagtcagaaggactaaattcaatttctaaccattgtggatcggttctttcctctctctctcactctctctctctctatatatatatatatgtatgtatatatatattaattattttatatattaattaatatacatatattaattaaaggacatttcaatgtactgtcatgtgctatatgaggagtctgagccagagatgggactgtacatatgatggtgatcctgtaatagtatatcatctaatgacattcttgtttgcttaagtttgctctttgatgtttacttaacgatgaagtcacttactgtgcatttctagaaacatgtcatcatcatgaagtgatatgtggctgtacttatgtagtgagatctaaaattcatactgactgtatgccattgtaagattttgaaaaaccttttgaatgctgaattttattgaactgttagtctttgttatattttaatattttactctaatggtggctatatgtgacattgttactgtttttttgtcttcatttaatcacctataagaaaatattcactgccaaacctgttcaaagactgtcaagaaacataatttcactgagtcatctgtcatcttgagcatggttgtagttttctctgagccagacgtgaaagggtgaatcttaacattcatatttaaaaacaaatagattactttcccccaatccaaacttcatttgtaattcctacattttaaaaaaaatttgtaatggttgtattatttgaatgttgaattttgtaactttttgggcaatgtacattttgtaaaagatgagaagcatttaatttcttcagtcattgttgttttgtttgatctatgaatttcatttatctgactgttatttcttttgtttgtttccttttggttttaatagaacattcaaataaaaactttggcagatgatgtggtaaggtggagtgagcagcatgttattgtattgcttatgcacgttacattttcacttaaaaatggacattaaagcattgatatatgcagcatataaagtgactggatgtttagaaaatagaacagaataggataattgccaatagagcaatttctcccttttcacacattaacataaacagttgttgtcaggcacagtggtgcatacctgtaattctagcactccaaaggctgaaggaggattattgcaagttggaggtcagcctggtgtccataaggagttctaggtcagctagggctaagtagtgtctcaccattcctcaataaaatgaaacaactgccctaaacttacataaacagctgggtcatatcccagatcaattatttctttatctttgtaacatataccaaagcaatattttaaagttttgtgcataaaggtggacgctggaaaacctggacattttctcttttgatagccaaataaattgtggatatattaaataccaatattggaggaaattgtttacaattcaaaaataaattaagtttattatcttagatatgtgcttattgaattttaaaagcttatatatattttcaagctcagactacaatagtaattcttactaaaagttgtaagcaaatatttaaatgtactctttttacttaaactttcttgaataatattttaaacagtttcatttttttgtctgtttgaagttacctatcaacaaaagatgtaaaataatgttactgctctaaggagatgaaagtatacaacttgacttcatcttcttacccaaatacagctgaaagacaaaggcagtttttgcattaaagtgaagggcacagaaatagcaaatctatatgttagtaatgctgatattcagtacagaagcttagactgtataagtattcttcagtgatatgaagtgagtggctaactgcatatttaaatgctttcatgtccaccatctctttccgtaaaatttgactcagtttatttgggattactaaaattgtttttcttgagttgtgggaaggaagacactacctatgtaaaccaacttaactgccctcaaagacatacagtaaaacccaataatacagttcaaataattttaaagaaagaattgtaatgtgaaagctgagatcagaaccatggtctcttgtgtttgagtcacctgttctgtgaattgaggaagtaggtttagatgctatttcatttttcttcccacctccaaactattgtggtttctataatctctctgtaagcaaccacatactcaaataatttttgtaatcctaactaagctgcttaaaactgctgtttttcaaagtacacgttatggttttacaaaaaacattgtatctatcaataaaatgaagaatatgtactcttagggggggtcaacaaaattttccataaactgtagtgatgtctgtaatgtttttgtattcttaaaggttacttaaatgaagtgtggtcatgtggcagtgttcctccactgtcctcatagctaacatgtctgcttgcttaatgtgacttgatattgcatgtgcttcctaacagacaccagaataaaactgagttgccttcagttttatgaatattactaatgtttgatgtcagatatttgatggcttttaaaccaaatatcctcttgacttgcaagcaaagtccttgacttacttgatacgaaagagcaagctaattgttagagattgtacatggtatcagtggtttaaaggaaatacccacacatcagaatagtatttggaggaggaaggtatttctgttttcgtttccaacaaatgcagaaacagccaccacaaaattttgatccaaagtgtctcttcacttccttccttgtaaaacagaaatgacaagtgactaaattttacttttgaggcatgttttttctcccccagctttctgaagcttaggaatgacttcagggttgcaaaaacagtccaatctctaactggagcttgctgcttacaataatgttttgtcaaaagagaataacaatagataacatactaagtgccattttgatgcttccattcttaatgtgcctggctcctgatctttttctgagggctttttatttttctgtttgtagcgtgatcgaattacaagtttcagaaaatctactgtcaaaaaagaaaaaccttttattcaacatcctattgattctcaagtctcgatgagtgagtttccagtggctcagccattatatgatgaacgatctctgaatttgtctgaaaaggaagttctggacctttttgagaaaatgatggtgagttcgacctctaatttcattgtcattttaaactgtgtatgtctagaatagattttaaatagggatgtttgtagttgactgtttatgtcatataaaagacagatccaactcttgttaaaaaaacaaaagtatttccaagagtacctggatttgtttgtttatttatttgctagaatgcctatctgttctagtcagagtgcctaaaatcagacacgggtttattcctctttgtcttgtagtattttgtggtttgtggcacaccaaatcaatttttcaattaaataatctgtgtgtttgctggtccaaagcaacatgtgtccaagtctacatgatctgttgagtagatgaaatatagttgggaaggcagagtgtaaaataaacaacaaaatggtaattggagccaaggaattaattcattctattttctcatatcagcaagagtcatacaacttacagtttgtagggtgtttcttaattttttctttgtgtgtgtgtcctctattatttctaaaataataaatgtaatacttggattattcaatactttatgtctggagcagggataaatgaagtattgggctatctcacattggttagcttgaccagatctcttttagagataccaaacattctcatctcccacatcaacatacattttatataaagactacaataacatttgtagcatcccttcctttgtcaaacaaaccctagtctatcttgtattattaatatttctcagtcactcaattgttcctgtttccgattccagtgtcccgtcttaattaccagaaatgttagaacccttctggtatttctctgcttaattgatgaaataaaatagaaggatgagaatgaaattttcttgggcctctactaccacatgtaccttgcttttagactctggactaattgctttgcttcttgttaccatggatgaaattttcatgtccaattctttattattattattattattattattattattattattatttgctgtatctggtttgcaatagaattcctccatagggaatgggctcccaaagaccatttgtgctctagggttaaagactagctccagtgttagaggtcccatagactgtcttggcctcctagctggcacccacattcagagggtttggcttggtccagtgctgtctccccacctttatgactagggtctccatgctttcactaggtcaggtcaactgtttctgcgagtttctgcagcaacgtcttggctcctttcatgtccgattcttatatgtgtgtatacatggagttgccattctttttttacctacttagatctttccccccttccattttattcggtgtatagctactgttttgcctggagtcattgtgtatgcctgtaatttcaatgctctggaggctgagggaggaggatcatggttaaaaaactagcatgcaattcatagagatattgtatctcaatccgttttaaaaaatagttctattcctactactttcctccaagttgcacacatgccttttatgggcttgaaacactatacaatagtgattcttaataatttgtaacttgtgagcactatatgaactattttataacctttcataatcatgttttatcatttaatgttaattctaatatttactacaatattatatatttttaaaaaatttaaatgtgtgaccttttgtagaacaatttgcttgttggattcattaattttatttaagcaaatgtataagttagtactacattttccctagtggaattgtttcattccatagagctttggaggaagatattaaacaaaaatatatttcataggaaatataatattgtgttattatttaatttgttgtatatcatatatatcattttcacctacataaaagtattatatacttgtatatcgacaatactgtttttatatccaatggtgtgattacttggttattcgatttactagtttgatgatgacgatattattttctatgacaatgataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtagttttataagatgtgaaaaacttacagtcagtaaatgtaagtaaatctattcagagagtacatatatttatagtgaatatgttataaacatttgtagcattttttcctttatctgataaactctgatcattgttcagttgccaacatttcttaacattttactactttgtcacactgtcttgatcactgataacagaaaaacagaaacactgatatatgtgtgaatatcatttataaataaacacactactttaaaataatagtataaatgcatcaggaatagcttttgtgagaaacatcgtttgattgaaagttaacaaccaagataaatgggaaactttgaaaggattatatctattctttgagaaaagttttcttaccccttgtttgtattctatgtttaatttaccaatattgccttccaatgaacatgttcttttcagaatcggcgttgtttatgtttactataagttcattgcccaatcatgaaactattttacatgtattatgccattttattcttatgactgttcttctaagtgtgtactaattgtttgatctcatttccaaataaggagattgagcttcagagagagagagagagagagagagagagagagagagagagagagagagactaagaaagttggttcagtaacttaaagctattaagtgggcatactgatacacacacttaggtacacaataaatctaaaacattggaattttggtgacatctatatttaccatttcattaaagctatatatcaaatcagtacgttttggtgtataaatattgaggagatgcataaggtacgagagaaagggtctgagatgtagcattttctgcagatgacagatccttatttgcagttgccctttatagaacctcaccaaaggccaacagccttataatagaaagctgttgaagtatcttcatcatagttgataaagagaaggcactgaagttactatttctgaaacacagaagtaggctttgagatatgaaatttctgtgatttcttcactacctgtgggtggcctccttacaaataatgtaaacaaaaatgttcttgtcttatttgatgattactaaaatgatctggttagtgtctcttgatgttccctttattctattgtttctcttagtgaatgtttgcagtttccagaactaccatggaactgtgtcaccatagtataaaagatgtgtttggatatttttgatgacatactgaaacggcatcaaatagcacctttcacacactttttttttttttttttttttttttttttttttttttttttggtttttcgaggcaggctttctctgtattgctttggagcctgtcctggatcatgctctgtagacccggctggcttttcctgcctctgcctccagagtgctgggattaaagtcgtgtaccaccaatgcctggtttagtttacaatttctaatgcaatggattatttaacttttttttaaagaaatagaatgttttcataaaatttatggggaaaacaataaaaagcaatattcaaatttattctacctcattctgataattgatagttttagtgcttgagtatcaaaagtaccaatagcatttctcattgtagcagttattagaagactaagtttaaaattacagcagaatagaactttcaaaataggtattagctattttattattaatcattccctaatactccccctaaaaccaccttgatttattttgaagttaatgaaaattcttaaatgagagggctatctggtatggcaatacatgactgtaattgtagcattcaggagtccaaggtaggtagatctcgggatatataggaaattatatgtcagccaacagggtacatactaagattcttccttgtctcaaaacagggtaagtgactcacttttactttgaatgttttcttgactctcacatttactctgtgcatccataaatcccttttcatattatagatatttgcatatttgatgtagcaaacataagaccatcttaataataataccactgtctgttgctgacagatttaaagatctcacatgttatacttttcggtaattctttcataaagcaaacgctctttacaaacagtattttttgtattatatcgatgtactttgcatctttggcataatttaatgatgacatagttacatgtaataagtgcttaattattggtgtttttatttcacctgttagaattctcacaggtaaatctaaatcttttaatcttgttcttttccttttctccttcattaatttacaccgaagagttgcctctggacaccaggtgctctactttaacccaagcgtattgcattcccttgattgctgttaaaggatatttttttctcactcagcaccagggttttagaagttggttagcttggctgagaacctttgattgcgctcagcgtaagtaattttaataacagttaagtttccataaaatacattattggtaaactaggccttcacatctacaaaaagccatggaatagtgtcggaaatgattagattctaagaaattgttcagacagcccaattgccaccagttacatttaaatttcctacattctttcccccatattttagaccgtgctccacattttattttcctgtgaagaattgtgtggaaaacatgtaaaggagtagtggcatgtactcagaaaacagatgtcaaaactaatctggatctggatcagtttaatttttgccattattagtatcacaaaaggttcctgagggaaagagaaggaagacaggtattgaaggagaaaaaattaaagaactaggtttgcaaattgatgttgtagtgggacaaattcaggaaccactgcttttttttttttttcttggcctgcatttggaaatgccttgaaaataagtacctttataaaaaagggatttttttgtgtattctttatgaatacattttagcaattatgagttgatctgtgttatgatatagatggtatgctatgggctgcaggtttagaaataaatgtagcacctacttttatccacagagagcggagttcagtcacatagacaggtagctatggcgtccctaaaattgaggctagctgtggatcagctgctttagtgggagatataatatagtcctttcagcctctcatgggggctcaggaaagaagcagatgtagaggtaaggaaagtgtgaaaagccagtgtcaaattctgaattttcagtctttgtttttctggcatcagtgccttctcattgtttgaggaattcatcaaagttcaagagttcacttgacactagtgtgtgtgtgtgtgtgtgtgtgtgtgtgtgtgtgtgtgtgttgtgtgagtgcaggtaggaatgcacacattctgcagtgtgtatgaggaggaggttagatgacaacttgtaagatttgattttcttcttccacctactataggttctccagggcccaactcaggtcaccagacttgtaaggccagtgcctttccctgcaaagccacttcactggctccatgctttatgttttaaatggttaaggagaagagtgtttgaaggtgcatggaaattacatgaatttcattgtctacagaggagattttttttgtggaatgcagctatgtctatttttaaattcctattttgtgtctttgtactgtagcaaaaattaattctggtttaggctttcctggcctatatagagaattcaaggctaatctgggatacgtaggccctgcctcaaaaacttaaaccaaaccagagcaaactgaaacaaaataaaaaaataaaaccatgcccagaaaagaataaaaagaaagcagagactattaatgaggaaagtctaaaacacttattaccctgcactgacatactacagaaaagcattgtaacctcaggaatgattcggtggtctttatgctttttgatttttcttccccatttgggaatagtatatatataaataaatgtatgtgtatgaattcatttgtatatatgtatacatttttctgcatgtaacctcaaactgtctcattttcaactatgaatatatgcatatgctaatgttatgtaccttataaggtgaaggcatattcaagattgtgaaaaccttgaaggaatgagattgtccaatgaatatattttttcagacaaaagtcttcactttcatgatggtttttattgtgtgctgacagtgagcccatgttttttatgtcttgttttaaaataggcagcaattagacatctttattttgatatttggcactcaaagccaaaagctgacaaagaagcccaagttcagggctgaatagatggcacagtgtgcttttcccgaggacttggtttcaattcctagcacatacttgatggtttccaaccatttgtgactcctgtctcaagggatctaacatctgcttctgatatttgaaggcaccaggcacacacacatggtacacagacatacatgcatcaaaacacatttaaaaatacataaaacaaaatgctggtccaaatgcatcaagtagatagttagcaaaaactaaatcagaacattgacttaccaatccattccattaatcaagcttcaccaggacaagtaaattcccttcccctttggtgacaaccagttgtgcaatgagtatggcatgttatatattaaagtttctacattaatgggttcaaatgttctttagtgagagagtctttaattaatgctattagagaatagactctttccattttcacttccgtgtcattcatatatagatccttatcctcatgagtgtctcctccagacagtatctagccctgagaagaaagaattaacagtgattccagcagaagactgatatggaagttgggtcagccaatatgtgtcaatcaacatgaagttctttgaaaagaagttactttctaactgggcactattttgttaaattaaaagagaaatgcctaaatcatggtttaaaataatggtgcaataaccagagatgtgtttgtagggagaaaatatattctttctttttaaaatgtattttgaagtattcatgcaagtacagattgtatgtttagcatttaccctccctactttcataccttccctttttttcaatttttttaaagattttatttatttattatgtacacaacattctgcttccggtagaagagggcaccagatctcataacggatggttgtgagccaccatgtggttgctgggaattgaactcaggtcctctggaagagcagtcagtgctcctaacctctgagctatctctccagcccccataccttctcttttatcaacactcccagcttatactagtccttttgttccccatgacagtttcaagtctattttcatgtcatgcacatataggattttacacatttatataaactttcagaaccacaagtgaggggaaacatatgttggtcattctgacattagcttacattatttactatgattggggagaaatattttcataattatgtaaatattttactgtatttgtttcactctatctaaaatagtttatagttgtttcaacacacacacacacacacacacacacacacacaaaactagttggaactcatcatgtacccgaagctggccttgaacttgtggtcctccttgtagctccttgagtgcatgatttataggtgtgagatattacccttgctggcttgatttttttttttaaattttgtctttttctgtaaataaaagctgacttatttatttgtatagcagtctgtacactttggtttaaaatactgtttgagttgctggtcgttggtggcacacgcctttaatcccagcactggggaggcagaggcaggcggatctctgtgagttcgaggccagcctggtctccagagcgagtgccaggataggctccaaaactacacagagaaactctgtctcaaaaaaccaaaaataaaataaaataaaatactgtttgaattttccacatgtaagtgtgttcaggaatcctcgccccctccctctctctctctctctctctctctctctctgtgtgtgtgtgtgtgtgtgtgtgtgttgtttgttcctgaaagcatcttcttaactacagcttttattttgtcaatatatttttcatgttaaattgttctgttagtgactccaagaaaaatgatgtgtgtgtgtattgaaacaactataaactattttagtatgagctattttacaaaatatctgtattcatccagctttatagtgaaccacccacacttgagtcactttcctaatacctgctttagcactttttttttttgcttttgcaatgatttctgtgtgtcttgtgacagtatttgatgacaaggaaggcatttgagtttttgttttgcatttattatttcagctgcttttaccaagtgttttcaagcttctgtggggccttttgtttcttgctattaagaaaattcaaaagaggcacataaacatgtgccattaagtttatacactatcagtcaggtacaggattgagatcatgtgattctaattattgctgagaaaattgaagacgctgtcttcatgctctggctgctaagatttaaatggtttgttaatttgaggtggaatttaactaccattgcctaagactttaaagtataatatgcacttaaagtgagagtcatcatcatgattgataggtaactgtatttcaaatcattactttaatcatttatgtcttgaggagacagtttattagttagatttttgttatttttactatgtggtaatggataaaagatgaagaattacaaagaagacatctaacagtctcccattttcttgttcccttgcgctcgcattattggtattatcctattatcttcaatctgttgtctttataggaatcacttagagttgattttctattttctgagggcttatttggttaaaaggagacaaaataatcagtaaatatacctaacattaactgtagtgtgttgtagtacactgactgcaaataaatctgcattgtgaatatttcactgctcatttaaactacttagggtaccattcaacctatgggtccaaagaagaatctagtgtatattctctgttaggtattagtaaatcttattttctttaatcttttgaatgactgccatttttcaaccctcatgggtcctttatgtaatctgtctactctagaaataatggttgatgattgtactcacaattagcaattattagacagtgaaaactctagttatgttttcttatattaaaatacatgattttgggtggaggcctctgacaggaccttgaaaaaagaaatagacaggaagttgtgcatgaaacttagtaatattcacttaatattatgtatgcctttgtgtttagcctcattctatattcagaagtactatcttttcactgtgtccacttgactttgttttgctaccagagctcttatatgttatgtggctatagtctatatagtttaatagagttacccaaatcttttgaaaacttgaggcagttgataactgccaggtcaactggccactaattaaatgacataaaaaaaatctgattttcattttaatttaagaagtaaatatttgttcttgttttgttcagaaaagctagaattatggaatagaaaataaagttttgggtatagggatgtatacttgagaggttgaaggattatgagttctaggctagcctgagctacacaacaaaaccctgtgtcaataaaacagaagacaaccaaacttaaacttacctaccacccacacaaccaggaaaatcatttgtttaaataacattataaaattccactaattttgaaatgcaaaacatcaaaaataattaaatttattattgacacttgcatattttaggtactagagtgacattaattaattttccataaaggtctatatctctctagcctaagatttggaggcagagaaaagagaaaaccagagagggatgagaaagaaagaaagattaaatgaagtaatatttagctggtacaacttttaacctcatcttactctatttttatatagttccttctgtatctctgtagtcgttcagtgtttggggttatatatgtaggtcagtaatatagcattgctgtatatgtatgaggttctgagttcaagtcccagcaccaaaataaataaatgaaataaaagcaaaacaacaagaacaaacaatatttgaggtagtaaaggaatgtgtctagagagagacaggaaagagatgctgtggcttggttgctttgcttctctaatcttcagcttgaatcccaatatttgtctctaggtttttattatttgtgttgcaatttacaaatatggctttgctgaaaactattctatgtggtcaggtatttaaatgtcaacatcatttgtagcactacattcctcatatattgttgatacattaaacagacatgtaatatgcttaaaacttgctttctcttttgactatcaaaagaactgtgttcacaagtagtttcgtattcaattatgttgtctagagttaatattgagttacaagcattgctctatttagttttattattatattttaaagctagagttaatgatttggaagtatcagctgcacaattagtagtattttttatttctagaagaattaaatgagtcattatagactcttttgttcatatgaacgttacccattcctaaccaatgtaggcagccatttcataagtgaaaaatgctaataattctgaggcaatttcaatatttaaagaaaaggcccaaatatcaccccacctcaaaaaattttagtaagtgcttactgtattccagggaccaggatcttacctgggattgcagagctaagaaagttcctgccttcagttaccttagagttttatggtgatagttctctgacaaattgttaattataaataaaattagtatggaagaacaggatgaaggtttccattttgaaatggggcaatccagaaaatcttatggaaagcttagcggatgagtgtagtttaaagtataataactggccagcaagacacaaggaggtaggccctattgcaaaggatatgacagactctgaagaccctctatggaagacctcaccctccctggggagcagaaaaggtacgggatagatagggtgttactgaagggggcaggggaggaggggagggagagggacctgggattgacatgtaaaacaatcttgtttctaattcaaataaaaaaatggaaaaaaaaagaactggccagatgtagatttagctggaggcagcagctcacactgtgagaggtggcaaagggaacaacagtgggaagtttgagtcagcatagtatgtggaacaatcacggccgaccttgtattgaagcatagagggttaagccagaagaagttcccaaaatgacggtgaggaattgatagccgtagtggtagataccattctgtgggcactggttaatgtacaccaggcttgatatatatgatcatactcaattttgacaacattctctgaggtatataatcttacattcctcttactgccttgcctgttattctgacaacaccatttttgatggcctgaccactgcagtgcgtgccactaaaaatcaaatggaggtaccaatgtggagctatcactggaaggagagaggatactactactcttttaggatatgtggggatgtttacacatccagaaaattctgacagttgcacagttgattgtacttgggacatgtagattcgttgtaactacttttatttcagacagaaacgtcatcagaatgtttgaggcagtaaaaactccaacacttgtggagagaacataggaattttgatgaaaaccagagcaatatgaggctatggaatgatgtgcttagccaataaccctgtaaaattcaaggtcgaatgaatagatgtatattatttcaaggggaagaagaagcctcagaatatttgagagtggtagcgatagattctaagtgatgtcacatgaacataaattgaaactggtatatgtatattttagcccgagaaaatgcagacgtccaaaaacatttgcatggttcttaaattaattcccttcaaatcctgctaccatcctctttagtttgacaattaaagtattcacttgaaatgcttcagtatctcacatttttgaaaggaaaaatacatgatgtagatgtttaaaagtagactaagtattaagagatattagcttgctcttcaatcaggagtgttgcaacaatagactccagatggcattataggaattgcttgcagagccacatagtgaaatatagtctgattaaggagctgttgccactccagaaccaattggtctgtctaagtaaaaaatttgtggctgctgccatccgctccctatctacgtcatctctgttgccacccacaccagcaagatggatggcctgttcctggcctatttcttcacctagtttataaatgcatttcattggtgaagactaagccacatgtgtatattgaaattacatataaggatagcagacaaactccgtttttatggagtcatttttaaactgaaattgacaatgtgaggatgcatgaaaacgtagaaggcatgtctaaaccgtgttgggtagccaaaaatgacagatgaccactggaatctttcaactggtctcctggctgttagtcagatttttctcattcttcataactcaagtctaggctaaaatctttgctgaacttatttaccatctgtcttatattttcaaggaatctcatacatgtctccattataattccttgtacctattagatcatgaattagttatgtttctttagtcaacaacatatataacatttctaaggtccagccattgcttcacaaataatagcatttaatttgagtataaaaagttactcaacttttcagtgttaacagtctagcacagttccttatgtatactatatgttgaataaataagtgattctaattttaaaagaagacataaaaagtcaatgtcttttgactttaatagtttttaaaattttcctgaatgtattttgtatctatttctataaggaaaacattagcaaaccttaaactgcacacaaatgggtaagttatgagtgagttttctgacagctacaatagaaggaggggaatattttataagagtaaatggtttgtaggaacaggtgtagagataagaagtggcagagggggagtaacatgatcaaagtatgtttcatacatgtgtgaagcttcataatgaagcatgtatatggttgataatttaaaacagagtttttcctgtttctcatacatacatacatacatacatacatacatacatacatacatgaatgcagagagagagagagagagagagagagagagagagagagagatttcctcttttttctgtttcatatacaacaactttctgagaatttttctttggcgatgtatctcctgataaatttgtctatcacatatgttttcttgggtaacagtggtccttgggaaacatggaccaaagagtagtgcacgagtgtgtgtgtgtgtgtgtgtgtgtgtgtgtgtgtgtgtgtatttgctgtagagataagtgaatggtttttctaggactgtataatgtacatctatgttatgaaccaccaaagtattccatagcatagtttaaaatttttctttagttttcttcttctcacagttcagctagggagaagtataaatcatgaatacatgtgaaatacacacaacattatggtatctcaagtagtaaataataacccaaaatatgtctgttgttaaatattaattgcattaatcacttttgtgatgcttacacaacaatccatccattctcacagtagatgttctttctaataggaggatatgaacctgaatgaagaaaagaaggctcctttacgaaacaaggattttaccaccaagcgtgagatggttgtccagtatatttctgctactgccaaatctgtaagtagggacaattcccaggcaccaacagaatgagcttagctgtttgcttaaaggttaacaaacctcaactctttaaatttttgcctcagtgaattcatattgccaattaaggaaacgacatgtgtacacttttacatattttgcacatatatctcagtactgaactgtttattagacatgagagatccatgattataagcaagagaccagtatggaagtctcttgattgaattcagtgaatttgagggcagaggctttatgcagtcactaaaaatttccagtgttttgctggtattctacctactaaacagattgctacatgaaattttcagatttgagggagaaaacacaaacagcccagccacctttaatcaagtttacattgaagcatgtacttttaaacaatgtttttcatattttgctttgttgttttgagtgcaaactgtgtaagctgcctcataacctgtgtggtaaagctcaccttaatataaaggaaagcaaacaccaggaactttaatcaaatctgtatgaatttcaaaacctaaacgtttgtttcattgaaagaatttattgtcaacaagaaaaacttactcctttaatagaattgtttattttttcttgttacacttctaaagctctttgaaaagcaaccttcagatttgattttttgtaggaaattatatattattgatatgacaaaatatatctcttgtattcttgtaatgagctttatatgtctagatttcaaaaaatcactatgtgcatgtgtgtatatacatgcattcatatatatacatacaaaatttatatgtacgtatatgaatatattacatatctgtatttgtacacatgcatttaggacaaagtattttctgtttaaaacattatccactgaagaaaatgtccttaactgtaaaagtaaattccagcatcatttggtaatgtcattcatactttttagtatactaattccagtagcaactgaagaattttgtaattatattgcttcaatattgtactttaggcaagctaaatctgaatgctgaactatttaaacataatgcattgcagctctgccagagcagagcaacagcatgttttttaatttggttctggtatccaagggcagaaatatgtttcaagtgataagtgaaatttgccatgagcattatatatatatatatatatatatatatatataatattatatgagtataaagtagaaataatatatgactaatgatattgtgttttaatgatggaatttgttagcatctctggctcatttgtgggtgttgtttgggtaagtgggattatctataatgaagattatatgacattctcatgccttgtcctttggataattacacgttatctatgcacagcatttttaatttatgttcatatggtattctctttaacccaccaaataaatgtatccttgtaattcttatgctcattttcatattgaaatgaaaaccaattggctgaagctcttgcttagcaggaagtgcaccagcctaacctattaaggctctgaattccatctagcacagagacagattgggaggaggagatgcagaaaggtgggggaagggaagaggctagacaggagcttattttaactccttaattcaaatgatagatatggagtgtttctaacaagacatgaaattttccatttgaagtagccacaaaattagtactacttactgactggatggcccttatttctgtcatccagtgtgcttgttagctcttcttctttcacaggaattccaagattatagttgttgctattatttttcatgggccaaatatttcgatggaagagagcctgttgacaagtagtgttttgaagctttctcaccttggagagacattaattagtactgttttctgtcattaaaactatgaaaattgtttgtgtaatttccctttaaagataagaggaatgtcattcgatgaagaacaacattcaataggaaacagtgctttcacctgttcatcatcatgacagccaattttgcaccaattatcactgaatgtgtggctgttgcttgtgtggagcttaggttcctgcccttctgtctggctttcataaggtgttaaatatgctttgcctgtcttgtacattttttactcttttccattgtattcgtatattcattaaagatgtttcctcatttaatgcagatgtgatgatgcctatcatgtgataaaaagtctttgtaggtaatcaaagatctcatctgagagtagaaccagtgtcaaagtgcaaaaaacgttcaatagtcacaagtaagatacaggaggcctatagttgaattttaatgtaaaattgttttcccctttaatgaactgcattgttcttttatgtggaatttaaataatgataaagtgagctcattgaggaaagggcattaaaagatgatgaagcagcacacagatatgtgtcagaacctgtttctaaaacaaacaagtctggtgctgcatcattaatttttgctaaaattagtattggataagaggatattaaggaaactacaagttaatgttgtaaaactattgtttggtcatcccttcacacttattgtaaagttctataatagacacttgtgtatgctaaagtaatggtagattgaatatcccagtgatgagtgaactttaaataggtatgtgaagaacatagtgtgcttttattgctctgggagccaaatgcttgtattgtaggaggtaccgttctaggcttgacctaagagaattagccgatatgaattattttgttacaaataacaaagtagattgtatagtttcaaagtgccattgcagaactggaaaaaaagctgctggtattgttaaagctgccctactgattcataacccagaatgaggcacattatgctgctgatttagagaagatcttgcatactcctaacagagtatgtagacattcattaggaaatgttatccaccagagacctaatgttagtgcatcacacaccattatccttacgacaatatgaaaaaagcagtttatttctaattttaattataccttctgaaatttagattttaggacatgtcagattacacttttgacaatgtgtgagacattcagaggtgtaattattccccccaaaccctcaatagtacataatccaacatcattagatcagttgtgtctcaaatttgtagatttaaccaataaaacaagtagatgaaagctacggtgcacatgacaatatgtatgcacttattgtggctgtgttgttgccattttcagatactttttcctcaggtccttttcatacatgggatggataaggagaaacagttgagcccagataggaccaaacatttttctccttggttctcttaactaatcaatctaatatatttctctgtgtgctttagctaaatgaaatcattttgcaatctgatcaaatcattaaaacagaccttgaatgggcaacattttagttgtttcactgactacgaacctgcattaattgttaacacaggctctcattctttccttttggtctcacgtctgtgctaaggaaacaagggacaaatataaactctgtcttctttggtgggaggaaataatttaggtcaatagcatatctttcatttcagaggactgttagtcacaccaaagaagcttctattcatctaaattatcactgcttgtaaatagcgtgttatatgaatttttaaggaacttgcttcttcatttggaggctcggggattcctctgaaatcgtttacagccaccattatctttttgtatcttgtagtattttagtcagctgaggatacttacttggctttcaattaaatttgatgtttgttttaaagcactagctgaaaaatacaataggtattgataataactgttatcacatgaatcatgaattagctctctttgatacaatgcttaatattcaagtgtgagaatctgataacagtgattggacttatattttgatattggcataagaatatgtttatgttgagagttccctcttgttttcttaagcacagtcctgcctctcagaaattgcttcgtctcttgaaatttctgatctgtttcctccatattaatatgtgcatttttatggataaaatacattgttttcacatcatatagagaaccctgacttcatacttggaacagtatgatgacccagaaaaaaataataacaaatgtgtcttatcatttaaaagtataagtcaaaatgatattgtacattttaaatttgtaacaatataaaacattcagttttcaagtcaagttcatttcagaacttgatgcatgactttaaatgaaacatttgtcatttaaaataacttaccctgaccttaacactatttttaccatagctaggaaagaaaacgagagcaaaatttggaaaaagttcctactggtaatttcttttagtggctgtgagtagggaaattatctgagtgtatattggagttttattttatatttagattgtaatgcatggaaaacctattagagtgcagactttaaagaattctacaacatcatgataatttttctgtatgtgtaaactctatatttaaaatggcacacattaatattgctatcttgttttaagtttgttactagagtagactagtgactaatttactaaacaccttctttcaaagcttctgattactaatattattgctgtttgttttttttcacactgtaaccattctccgttgaccactgcatacagatagttggaagtaaagttacggtaagtacaaaagatatgttttacctttagtactaaatttgtgtttcagaaatttgtgattttttgcatgcagtaattaatgtttagtttttgtttgatgtatatttttccaaagtgttaaggcaaatattgacatctagtgattacaatttaggttggttatgtactttcttacagttttgtaatatattttagaactagaatatgccttggttttcttggagttttttcccccttggagaatcatgtctgtcattttagacaacatgggtgaaattgtgtggtgtatgtcagtttttcgggatcagagtgtttgtgtatgtgtgctggcattcctaaaatattggtcttctgtttacacaaattcttattttgatgtctgtctttggtttgggcatcattgatgtgtgtgtgtgtgtgtgtgtgtgtgtgtgtgtgtgtgtgnnnnnnnnnnnnnnnnnnnnnnnnnnnnnnnnntgtctgtgcacgtgtgttcatatcaactgatgctattcagttaggagtcctgaagatctggctttgtaggatgatatatattgactctgccatttggtgagtaatttttttccctgaacttcagatattaagtagataagttgaaatttcagcttatgttttaaggttcttgttggtgctacaatttaaagattgtatatttatggtattgtagttgtaatataacaagctggacattcctgggattgtatttcagagatgtttataatgactttgtctccttgagtatatgtcatttatttggagaatatagcatatgaagcatctttaaaaatcacagagaaatgatgaatttagtatagtcaatgtgtttactgtacctgtaaaagttccttacttattccctcctttcctcttcctccatgggagatgttatatgtggttaccaggaacatgttactatcctctttaaaatcttcaaatggctctcagtttccgggcgttggtggcacacgcctttaatcccagcactcgggaggcaaaggcaggcggatctctgtgagttcgaggccagcctggcctccagagcgagtgccaggatcggctccaaagccacagagaaaccctgtcttaaaaaaccaaaaaagactctgtttccctttataatctcatctctgattcattaaaatattgtatttacttgtgtgtgtacatgtatatatttcatggcatatgtatggacgtcagaggacaactccctcaagtcacttttctcattctgccatggggattttgctcaggttgccaggccactgagctatctctctgatcttaggcttccttttaaaaatgtcatctttagctgtgtccctgtgtttatcctgacaggtacccttgacgcttcctaaggatatttttttttcttgaatccttctaaatcaagcaagaaaagagaatactcttttcttctttggtggcccagcaagtacttctaagtatccatcttgattaactttcatgttgcagaaagaagctctcccatgtcagtctttccattccctgttgccctactaccatatttttaacattttagaataaagctcttccttgtctccttttgcaaatcaacacagctttttctttcaagaaactgagtctaaaggggaaaaagatagatgacaacagacaagtatatttaacagatagaggtccccaagaggctgtattgttatagcagatggagagactagcagctgtgcatggatcccagagggtgttcaaaggtgatgctttgagattaagttctatggatagatctagagtatgtcttctttcatggccattttttgcccatttgaactgtcaacttctgttgccaagaagtaaactatagtaatcccttctacaggaaatgaggaaggtttaatttaaagttgaaacaggaggtatgcattatggagatttgttttgtcctattttactttatttaatattttgcaactaaagagagagatgaaccaacaatatataaaatcacccgagttaaaagacagcttcaaagggcttatgtgtcataggctcattaatctccaaaaggtgggaggagtatatttgctggtaaaataggcaggtagaaatttcatagaggtgctatagacagtagaattctcatataacctatttaagtattgtgattacttagagattttaacattagtttaaaaatgagtgttggaaaagctggaatgaaattggaaaaatggaatatacaatgaagtaggtctgcatggccttttctcttttgtttctttaacactgattgcgagctgaaataatagcatttgaggccccgctgctgtttttttttaccattgctgttgcttttcattttttatatttataaagtttacttaaaaaacaaacctgaagctgcctattattgggatataactacaacctcatcctcaggtcatactgattctggctgtatgaatatcttgcccatattcactccacatcttttgcataaagcctgacttaattctgactccccagaccacctcccatttccactggatgccttactggaattcctgtagctctttcttttacacatgttgttcctttctatttgttgatttatatgactttacatattccccaagggctttttaaaaatgacattcctattttactttatagcaatttacatatttgaacagtaggtgctttcattgtttgggtttgtctttctgcgtccacaggacagattctatgttttatagaagtcatacatttataagaaaatgggtccagtttcagactctgttggtgcataaggcctgtatgatcttgagtaatttacagatcatatatgaacttcagacttcccattttgaaatgaaaatactaagttcaggataggtttcagtggactatttgtatttaatatactcaaactataatacttcagtcatatgtccagtttatcctttcattaattatgattgttatgtaaacatgttttgaaagtataaaacatagcaataactttttaaactaaaattaagatcatgaagtatttttttctaagcatacaagatatatgctgtttgtaggtttaaaggtatgggtgcaattatttcttggtcaagaatgatgggaaggctaggcagtggtgacacacaccttttatcccagcactcagaagacagaagcaggtggatctctgacagtttgaggctgccctggtctccagtgctagtttgaggacagccaggtattcacaacatagtgagaccctgtctcggaaaaaaatggtgggaaggatttttctgaaaattcaaaaaaaggctttatctctttattggaagctgtatgttatttggtgtgtattattgctaggctttgagaaaaatgcaaaacaacaccagcagcaacaacaaaaacaatagaaaccctcctatgtggtctcaagttaatactgacacattaattttaaagtcactaaaatagttgaagattttctatagattctgtctatgatgggaaaatgataaaatgtcttccattacctctctaaaagttgcagagaatttggggtcaaatagaggtagaactgggtagaactgaatgatgaatttgggggattctagttctaataaatgtggtagaactttgtgttttggtagaatatgttttattgtttaatcacacctcaaataaaacagatttagataattgacttgatttcctgcaagccaggaatcctttatccacacacataaaagtaagcattcttctaaaaaccacatgatcttctcactagatgctgaaaaatcctataacaaaatccaacaccccttcatgataaagatcttggagagaacaggaataacaggaacatatctaaacatgataaaagcaatatacaccaaaccagaagccaacatcaactgaatggagagaaactcaaagtgattcctctagaatcaggaacaagacaaggctgtccactctctccatatctcttcaatattgtacttgaagttctagtttgagcaatcagacaacaaaaggagatcaaaggtatacaaattggaaaggaagaagtcaaactttcagtatttgcagatgatatgctagtctacatatgtgacccaaaaaactctgccagggaactcctacagctgataaacaccttcagcaaagtagctggatacaaaattacctcaaaaaaatcagtagacatactttatacagatgataaatgcaatgagaaagaaatcagagaaacatcacccttcacaatatccacaaacaatataaaatatcttggggtaatgctaaccaaaaaagtaaaagacctgtgcagtaagaactttgagtctttaaagaaagaaattaaagaagataccagaaaatggaaagatctcccatgctcttggataggtagaatcaacatagtaaaaatggcaatcttgccaaaagtaatgtacagagtgaatgcaatccccatcaaaatcccaacacagttcttcacagactttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgacaaagatgctaaatctatacaatggaagaaagatagcatcttcaacaaatggtgctggcacaacttgattcagacatggagaagattgcagatagatccatacctgtcaccaaacacaaaactgaagtgcaaatggatcaaagatctcaacataaatccggccacactgaatcttctagaagagaaagtgggagatacccttgatcgaattggcacaggagactgctttctgaacattacaccagtagcagacattgaaatctgcaattaataaatggaacctcctgaaactgagaagcttctgtaaggcaaaggacatggtcagtaagacaaaacaacagtccagagaatgggaaaacagcctctctaactgacagggggctgatttccaaaatatacattgaactcaagaaggtagccaccaaaacacaaaacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagagaagaggaggaaatggagtagcagaaatattgagttgggggaagaatagaggagagcaggatgagggataccacattagagggagccattttaggtccaaggagagatctggcactagggagannnnnnnnnnnnnnnnnnnnnnnnnnnnnnnnnnnnnntaaggggagccattataggtccaaggagagatctgacactagggagatttccagagacctacaaggatgatacaaattgacaatccaggcaatggtagagaggataacctaaacgcctttcccctaaaatgagattgatgactactttttcatgccatcctagagacctcatccagtggctgatggaagcagaggtagacatccacagatatacactgtggacaatccaggcaatggtagagaggataacctaaacgcctttcccctaaaatgagattgatgactactttttatgccatcctagagcccttatccagtggctgatggaagcagaggcagacatccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcattctaggaggcccctggtggtggattagtatttttccctgatgtaagaagggactttgagagcccatcccatgtgaagggatgctccctcggcctagacacatggggaagggcctaggcccagcccaggatgatgtggtggactttgtagagcccccgttgagggccctcccctgcctggggagtggagggtggatggggtggnnnnnnnnnnnnnnnnnnnnnnnnnnnnnnnnnnnnnnnnnnnnnnnnnnnnnnnnnnnnnnnataactggatgctggcatgtagaagactacagatagatccatgtctgtccccatgcacaaaacttaagtccaattggatcaaggacctcaacataaatccagccacactgaacttattagaacagaaagtaggaaacaccattgaacgaattggtgcaggagactgcttcctgaatataacaccagtagcacagacactgagatcaacaattaataaatggaacctcctgaaactgagaagcttctgcaaggcaaaggacacagtcaacaagacaaaatgacagcccacagattgggaaaagatgttcagcatccccacatctgacacaggacacagggctgggagcccatcccacatggagttatactccctgagcctagacacaagtgggtgggtctaggccctattccaaaggatatgacagattttgaagaccccctacggaaggcctcaccctccctggggagcagaaaggtatgggatagttaatgtataagtttgggggtggcaggggagtaggggagggagagggacatggaattaacatgtaaaataatctttctaattaaaataaaagtcaaataataaaaaaacacataaaattataactataatgattagaccttatagggttaaacatagataactttagtataataaatagatcaatgactagggcagcaacagggactttagtagtgtttgttttacctatggaaacagcagaatttaaatagctgacttatggccagacatggtggtgaaggcgctcaatttcacaacatataaggcagaggcaggtgagtgtcttgagttcagggccatcctggtctacatatctagctccaggccagccagagctacacagtaagatcctctatcagaagaaaaaatgcctaatttagcatgcattcattttctctgacagttagatacagggtttcatgtacccaaggctggccttttacttctcctcttcctgtggtgatctctcacacactgccattacaagcataccctgccacacccaatgacttctttttagaacccagagttattaggtacctgtcatatatcaggcaacgttcttggtaatattgccagagctcctgaccataatgcctgactttgcattctaatacatgtatgtattcagacaaaaggccacaaaatacatgaaagtggaaaaataattttgtttccccttttataccaatattggtgagagagagccagtttcattctgtctccaccctttccttagcagtgttatgccttagagggaaagatgaaacaaaagcctggaaatgcccatatagacctaggccttcagctcccatttagggaactggcaggtcagtctttctggtgaatggaccttttccactctaccttgacaggacctgtagaaagctggagctgaggaccacaatttacatacacaggtcgtaatttctaggcctccttgtagtgttagcatgataaactatacaggttgtcctcacagcagtaacattttagttgggaaaacagacagtaagacacatatcaaatattatgacaggttttggcaagtgctatgggaggaaaaatgtaaaaagagagcaagaggaggaagcacagtgatcagggatatactgttttaaacaggcgagctatgtgagcaagtgagaactcagtgaaaatggagacagctatgccgatatctagggaagagctttgaagccagagacaatgtcaagtgcaaagccttgaggcaagatggggcatggaatgtttgagggatagaaatgaggacacagtgggtaggtagcatgggatgggcaaaggacaggaaggggtttttaataaccaatgctaagagctagttacaatggctgcacatacacttaagtatagctagaggtccctaaacttggaaaggtatgctgaggtcattttaggagaactgtatgaaagacttgccagttgagtagtcattgggcatccctgcgagtttgtgagacttggaatgacagaatcagaggtttctgctgtggaggactcacagtagtagatttggagaggttagagactgaggactgagagctcaagcaagtggtttctgcagggttgtcatgactctgaactgcaatgtagttagtaggaactaaatggagggtatagacgagagtgtaaggaagactggatgtgaactatatcagtctcagcaaatgaatataaagggcacaggagatgtgtgccttaataatgactgaaatttcaagcgtggctgattaaaatgacttgagcattcatacagaagtcaagagcaagaccaagtttggagtccaagatgatgagttcagttagacacgtaaatcaaggagaaatggctcagaccacaaaagcagaagtaaaatctggccatgcaaggacttctctttagttttacagcattaacagagtgatttttataatggggctcactgttgcagattgctgcttttgctatttaaaatatactttctgtaccttgctgatgagaagagatcagttatcatttgaatatatttcactagctcataaactgaagctctattgtctttactaagtcaggagtgacatgagtgcatttcagtgactcggtgggttagcatagagaaggcaacacgtatttcctagtctggtgtgttgtctttcaaataggcgatctcaaatggttaaaacctgacttttttttttccttttgtaatctttctaagtaatctcagtccaaaggacaagctcatcgtagtgaaggctcagtgtgttacttttgcccctaatcaggttatgagaattgtctccattaattgagtgatttacagggttttgttccaaaagagagcctggtaggtctctaggattcaggatggtaaagaaagtaatgcagaagtagccataagaactcaaggctaagcctgcaccacagtttgagacactgtgaagacagcaagagagagacattgagatggagactgagtgattgatttatggccagtttctaagtaagtttacaatgttctttctatgcatctggcaataaaccctctattattagtagcattcataaagtattgctaagcatggcagcatgcttttgtgagctgtcaagctgttagtctatttttacatttaatatttatttatttagtttattaacagtatagtacctcaatgatttcttcatgttgacaatatacccgagtcacgccaattttctgaacatatcctttgaggaaagattaaatcttattttcctattttttcctttctataattaggtagtccagaagggggagacaaaacattgattattggagtttgaagtagttacttcatgatgataaaacattgctttctcatattccaagttgattgtgtttttctaacggatttagacattgtagaatagttgctactgtaaaagatttagttttgatggtggtaacaatcttattaaaaatctgcattcgatcagaataaaaataatcaatgtcattatttttaactataaagtagaaaaactcatttgttagtaagatgaaaagaagacccgagactattgagtggtggcatataataagtgatcttttaaagaactgcacaaacactattaaagcactcattttagtcttcactaatttcacattcattactgcaatgactagctacttgctcagtttctaatgctttaacagtgtgcaagcttgtgtattagacttgttttgggtaggatgcagaggatctgggaacctggctcagtggtaaagcatttgcccagctgatttatgcaacaaaacaacaagacccaaaatacatcaagacaaggatatctcatgtatttttaaagattattcattgcttaaatctgttggaaccatttctagtctgttcatactgtgcaggagatgctgcatcttatggaatgaaatacctctttgcacctgttgttttgtgggccccaatgattgagcaagaatgatctttgtgctttggagtagtcatttgcaaattggcaacattgattcatgtaaacagatgatgttatgcaacttcagtgggaggaaaaagtgcaaaattactgttgcattagggaccaaaaatacacgctggaagcaattccatttctatcattggtcaataagtttttgaagccattttttctatgctgaaagaaataaaacattgtccttttgcgttttatataataaatgttcacctatcttatgtactcctgccttttataattaatttcaattaaatactagctttgtttaattaacatttaattaaaatgcttataaactctcagaggtcaaggaccatgtcttagtataccttagacattttcaaataccctagcctgtaacagcaataaaataattagtaacttctgttcattcactgcattcttataactcaagtgaagttgactgcatatgaactgaaatcagaagacttctagttattttataatgcttctcaaaaacagtgctcatgctttgcagatgaagttcagcatcataaaaatctctttccccccttagaataaaaagaaaaaatgaaatatctttcttcttgataaccttttctgctacactgaagaaagttgttcattattacacatgaactctcctagggcacttgtaggcttaaggggcctttcagcttcttctaattcaagttatcctgttagagctgtcattttttttttactgttgtttctttttctttctttttttttggtgggagtacagtctatagattggggcttcagaactgttaagtatttctttgtaacccaccctgtctcgatgttctttttcttctttcgctcagagtgtagatgtgtctatgtaagtgttctccttcttcagtttagatgtgggtgaagaatattgggaagggtccaccttccacgtcattcttgtcccattatccaacatttttctccgattgtgtttgctcacagcatgttgtacacagtgaatcatacttacaggaaaccttccatacaaaatgaatgcttaatgcagaaattataacagttgaacaaagggatgcttcattattttatttctgttacagccaacagtatttaaattatgtctaatgcatgctaatacatggtccttgtcttttgagagttcattagcattttatttaaatattgctaattaaacaaagttgatgtttaactggaaaaattatagctcttggactttgaagacctgttgttgtcagggatttactttttctatgccacagtgacttgggctaaaagactaatttttctttagtccacatctccatgtgtattttgctatactgatggagttatgaaacacttgtaaactgtcaaatatgctacatattaagccattacagtaataaccagttaaagagataattctgatggtagttcctaatacacatttcaaaagaaatgtgttgaactacaagtgctggctgataatgcatttatgtattcatttcattacttagtgtcttctttagaagccaattatgcttttatcctttgtaaaatctcacatttttgacattgctctttggctaaagattatgtttactgtcgcttctttatgaaaaggcataagcaactatggatgtcatcccctaatctggcatctaaatatgaaaaatacccatctttaaactgtgcagccatggcatcgttatttagtctgaactccttgcttataatactccataaattaggggtttaataactttctaaaactgatgtcatagaaaatgagaaatgacaaagtttctgacagagtaatttcagatttctggtagtagttaagaattttccctcttttaaaaaggaacataagtataaaagccccaaattcttttaaatacatgatttaaaagaagccttcaaaattttacctttcttctttgtaagggcaatgtaattgcgatgagaagatggggacgaggaagagagggaaaatgagcctagggaatgaaaaaatacatactggcatatattcacaaaagtgtgaaaatgaaacatgctactttgtgtattaatttaaaagactgccttaaaaaaacagtgcattatctgaaagctagtggagttgaaaaagggaaatgtgcttgttagcttttttgtcaacctagtcatatctgggaagaaggaatggtaattgagaaaattccccttacggacaagcctgtaggacattttcttgattcctaattgatgtccaagggctctatgcactgtgggtagtgccatccctggactggtagtcctgggttctttaagaatgcaggctgatcaagccacaaggagcaagccagtaagccacattcctccatggcctctgtatgggctcctgtctccaggttccttcctgccttgatgataaactataacctgtaagaggagatgatccctttcttcctgaaattacttttggttctggtgtttatcataacaacatttagcaaactggaataggaattaaaaatgacccacaatcctataccccttatatgaagtgttattatattttggtaaatttatttatacacagtcatttctttgctgcattattatgttattaaaattgatactaatttttagtcaatacagttttctttcagaaatgcatatttactttataatgatataaactgataaaatacttttggtagattaaatatttgataataaagtagtattgtaataaacccaggcacccttgaatcccttaattacagttactgaaaactcaatatccagaaccaattttctccttgtttggtgatggcgtgattttatctttggaaaagttgagtatttgaatagctatggtccatctttgtttttaagtgtatttttctgtatagtttgagaaacctgatgaaaaattgccatgcttcctagtctattgttgaattaaaatgaaacacattgccatcaagatgtaaattttcatatttacaaggcacaagtaatttgaagacaaatctagaggtatggggtcagtaagtaatagcagaaatgcatcaaagagtttgacaaaatttggcaagccctgcttttccttgtttgtggggaaggtactgctgaattactattccaaatgaagcaaggttttcatttggaaaaattacttgtattaaacagatgactaggctgaaatagctgctaaaacaatttcatgcttttgtttttaatgtagtccaattataaaatgtcacatcaaattgtatgtgaatacacaaatgcataattctaattttatttttgagttatcacatttcaggaagttgattaaaatcacccaaaatattttctaagctttttgtgtataacaaattaatcacttttgaaatgagttaaaatgagattggaattttggcagataatgttttgattaaatgaattgattgataattctatagttacttgtttggtctgttttatgaatatgtaaggaactccctgccaacttttcttacttacttcagggcttccagatcactgcaatgctacaatgaatatagctcccactcagtctcttgttaaagcattatattatactacatttgctttttcagtcttttcctcctccttctttttccattttttggagtctttgttgctgatttgttatacttcaacctttcatgcttaaacatgtatcaccaaagagcaaggaacttctccaacatcagcagtgcatataatcaaatttaaggtattttcccccactgacatgatactgttattcaactatgcccatttttcaaatttccccaacggtcttagtagtcattataattatattcttacagtacagttaaagattaaactttattgtctgtatcttcctcatctccttcaatctagaacagtttggatgcattcgatatgtttttgttaagactttgaagaaaccaagtcagttactttgaaaaatgtttcccagccttgatttatctgtatcttcatgattaaatttagggcaaatatttttagtaaggattttacataggtgcttcttggccttagagcatcttatcatgagggatatgggtatttgctgccccatcataagtgctgagtaagtgtcctttatatttgaatttaataagtgataaataggatgttttgagatcatgtaagtaaactattacttagcaacattttgtatatttttcacacctgtggatggtattcttgctccaagtcatttattacttgctttgctacaaaatgattttctgatattgtctttatttttgcatttgttatatggcattcttctgtaaaataggattttattaacctccccttcctgtttgaattaaaaaaataatcattatgctctcatacattgcttatttaaattcactgccacaacttattgctagtctgtgaatgcctttcatgtttttactaaaaataacatataaataaattaaataagtaatgtatgcttcatttgtagtgtatattatctttaatccagcggccattctgatagtcacccacatgaaacattcgacaagtacacagcacaacttgaggtagcaaaagacccaacttgaaacattaattcattgtagttataaatggaacttacatgggttactgcaaaatccttttgaatattttaagtattaaattctactttttttccctttgagacagggtctctctatggagtcctagctgtccttgaattcattatggtgaccagaatggcttcaaaaatcacaaagatcctcttgcctttgccttctaggtgctgggattaaaggagtgtgtcttcatgcctggcaaaattctccttttaaaactgggactatattaagatttgtagttggtttgcaaaacaatgggtctcattatgacatttcatacacacatacatacaccccttgctcatctttgtcacctaatactgtccttccccatccattcatcactctcttgctggtctcttgtttcctccaaatagtttaccttatgttttcatggtgtgtgtgtgtgtgtgtgtgtgtgtgtgtgtgtgtgtgtgtgtgtgtgtattaactttttgtcaatatagattctgcatgagcgaaaatatgtaatattttgcttcttgccaccattactctcttgtttttcttccctttaggccttttacttttgtatcttattcatatgtattttatatttatacatcctttccatatatgagacaaagcagtcaatgtttgtgattgtgattctgggttattttgcttacagtgacgatctccagttaaaatttacttagaaaaatcttctttggacatgagaattctcactactgaatgagtaaagttttcagtcatcttcctgttcaaggttcactactgtctagacattaagaagagtttgtcattctgattatcaagcatgaatttacaaatatgcccaaatttatttttgaaatgtaatctgcagtgctgttttctggaatgtgggtaaacactacattctgttattcagaactttgcagtttcttcattctagacatttgcagccatgctcagtaaattatgtttacaaaagagagctctacttaaagtttagcccaaagttcagagcccttattctgtttactccaaactgatggaaaattacctccccagcactgccatttctttccttctaatagagagtgtcatcattacctgacccattcgactggttcattttaaaccctttcacttttctttttagggtgtctgtcttgggttctgtcctttagattatgctaatctgagtaattaggataaaatatacctgaagtttcattatgtaagagttacttgctctctcttaaggtaaattagttttcattcacattttctcttttccttcagatttatgttcaaactattttcctaaaaaaagtattaagaaaataaattacagaagcatagataagcatttttatgggtaaggtaaacacgagataattcccttatataatgaacaatcatcagtaagttattttttatgcagtactaggaattgaatccatggctttgtccattcagtagaagtactcaaccactgagctactttcctaatgtaagttattagttctttagtgtcctgtgtgtatgcagaatagctcaagtataaatattttattgagcaacagtcaagtggaaagagatgaaattaaaattaagatgtaatatactgtatttattgaaatagttttttcagtggtgtgtatgtgtgagtgtggtatatgaacacacgttgatgtgcatgtgtgtttgtgcacatggaggccagatgaggatactatgtatcctgttctgtcattctctgctttattaattgaacctagggctcccagtagtttcaaccggatctgtctccccgccccaacactcccagccctgagattacaagcatacatatcaatacacttaactttttacatgaatagttgagatttgaactcaggtcttgatgcttgcacagaaagtgctcttacctgctgagccatcttcccagcccatagacttatagtctaagaaacaaaattaatgttattgaaatgtattcaattcatcagtgatataaatgctcatacatattcccaatttcaattgtgtgactcttctatgacttgtctgtagttatccaatgatctataagccatatgacttcggtattttttgttagtcatttatttaaaaatatttatttagtactttctgaatgtgccaggtacttttatagatattgggagcatagtaggaaccaaaaaggttaaatggttcctcaagttgaaagtttacttggacttgtgatagactagaatgttcatgtgtatatttgctaggtaggtatcagttcctgtcctctcaggtagatgctagtgatggataggtatgattctctaggtttcaatatatctttataaatgtaacattttatttgaaaaatacagttagattaaattctcctaaagtattttctttcctgcaaaggatacagaattacatgacaaatgcacaaaatcagaccacagtgaaatcttagcaaaccaagggtaaattcggtgatattggtaaaacattcagaacagataccactatacagtgaagggtgtgtgaacgtatgtgtgtgaggatgtgacattgtagaggaaaaagccttgcatgtgtgagttgtgactaaaataggacaagatgggagaagaatgaggtgaagctcagtcacagtctagtaagaattaggaattacgtatttatatgttactggtttggtgataaagcttaggcatgagcaggctggtaactgatgccagaactctttcctttttggatagaaacaaaacaaaacaaaacaagtaactaagaagtattaagagtagaggttttcagtggtagcattggcatcaatagcatgtagatgtatcaaagccattagtagcagatgcaaattggagaaactgttatcagttttcttttttttaatttttttattagttcaagttagggaacaagcttgtttcacatgtaagtcccttctccgtctccctcccctcacccccatccttcctcccccaaccccagtctaccccccagcccatccaaccaacactccccaggcagggtagcgccctcaaaaggggctccccaaagtctaccacatcatcctgggccaggcctattcccatgtgtccagggcaagaatgtatcccttcaagtgggatgggctctcaaagtcccttcttacaccactgaaaaatactaatctactaccataggccccctagagtgcagacgcctccttattgacatccatgttcaggggtctggattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattaaattccagatttcagctcagtgtgtatctgtggatgtctgtctctgcttccatcagccactggatgaggtctctaggatggcataaagagaagtcatcaatctcattttaggggaagggcttttaggttatcctctccaccattgcctggattgtcagatcatgtcatccttgtaggtctctgcagatcatctccctagttccagatcttttcttgaacctatagtggctccctctaatatggtatctctcatcctgctctctctcctctattcttcccccaactcatatttctgctcgtccatttcctttcctctactactcttctcctgctgttattgtggcagctccctctcctctaccctcatgctcccaattagctcaggagttttctaattatctgtagaggtagtgactatgagcttgataattgaatggagatcttttatggtttgcatgtaaggtgtccatcacatgctcatgtgttggtatacttggtccccgcctcgaggctttgctttagaatgttatgcaacatttgggatgtggagtctttctagagaaaatgagctgctgagaagagtgaactagaacttctgggctgtagcttgggtcaccatctagcctgcggcctctgtcttctgatcatggagatgtgagcaagaagcttcatgctttcattaccatagacccatcactacagtcacctatcttttctgtatgtgccttctcaatccatgagccaaaatagatctttcccccttaagttgcctatgttatgtgttttgtcaaagcaacgagaaaatagactgaaacactgggacatcaacacacatgtttttgacatcttctgtttggtgcagcaataacagaatagtgaaggatgagtaattcataaagagcaaaaacttagttattttattgttctggaggataggaagtccaagattaaaatgctagcatcctatgtgaccgtctaactgcatcttctggagaggcagaatgaattgttctcataaacctgaaagaaaaagggcagagaggtgaaaggaggatgaatttgctgatttatcatagtatcatcccaccaaggagggcagaaccctcatggacctatcaccttccataggttacactgtcaatcatggtcagaggaacacctaaaattgaacataggttctagagtggcagatattcaaacatagcagtcttcacatgggaggcacaagccaaaccctagagtttcaggttctcttggtcaggaaagcagaaaggagagaattaaaaatagaagaatatatcagagagcacaaggatggactagaattgctgaagcaagtagaggagctgaagagaaaatccgtgaatgctacaagaaaacaaggagaggaagagtcaagtgatgacttttcacaagtttgaagtaatctctgtctttaaagacagttgaagaaaccaattgatctaagataccattgtacccacagggctctttttatagaaaggtactaaattctgttgccatcagtgaaacttcacagccttcagtagtataaaagaagttatttattgtggtagtgatcaagaatttggcagttgcaatgaattaaatagccccttgacaacttctgaagaagttgctgtctgcctttaagtgcttacctgattacctgggagtaatcaaagtgctgtgcagacaggggcctcaggtaattcccaccgggaattacttatatctatacaaataactatgattgtaagcagattttctgagagtaactggtggcagataggactgatgaacaatgacattgttatttgtatagttagttaacataagaaataaatacttgcagaaattacatctgagagggcccagagctgaaacatatctccctgggctgtgctttttgcctgatgacaccaatcctgttacttcactcacagttatgttttgttctgcatactaggattcttatagcattaggaagaattaaaaaggtaaaggaaaaacctggtgaattctgtatatattattgttagtaaattttcttttcatattgtccatgccaaattttggaaaatgtaataatcgaggctagaatgcaggcagtagcttctgtaataaaataattttttattatgtaccatgaggtaagccttattgcttcctttgatttatatgcaaatatttctttttcatatagtttatagtgctttcagctgctattttggtttttgtgctttagactgtctctattctttccatgattgccacaataaaataggcaagaagaaaaattatggatgcttcctgtctcattttgtgtatttgtttcagtggcagtaccaagcttttaggaaaccactgtagtcaatgtcatgaatttacagtaaacctgtggaatttacatatataaaacatagatgtcatgctggtgaattcaacttacaagaaatcttgcagtgaggctattagtttcaggtaatttaaatctcagtgggaaccaagaaatggattttgaactaatatatattttgaagccctcaaagataggagagtgtaatatttctgtgtaaagaagaaaacatctgtcattctttaaagtaaagaggtttaaatttaatgaagtgattaaaagtaatttcaagatttatttcccctcgataaatattgtttttttgttgattttaatggaaattgtttgaaaaattagccccgttttcagcataatgccaagtaaaaatgaagcatatctttcaaggtagatgtttttttcaataggggaaatgcaaaatgacatgtttttgagactatatacccatcctaatataatttattcagcaatcctgttcttgattacaacgatagtgtcttctttcaaagggtatttaatactagcttttgtatcaggtaaacttacatgtttctaaaatgtcctctctaattttataactcaaaggaaaatgcacaactgctttaaataacaggtaggaacactaaccttatatgtaattttcagactgtcttttgggtgttggcatctttggcactttgtcacacatttgttttctaacatttatggtatctattgtcaagatgataagtcgcatgctccccatctgtgttgtcagttcacttactttaagcttatcacacttctaatatggaattataatgattgatttactaccctatctcttttaggagactgtgtgatcattgagggttaggattgtgtttgtattctaaataaattctgccctgggttcgataccttcattgatagctgataaattctagtaaggcccccaccacatgcagtgaatgattctgctatgacttagggtttgaaagatgataatatcattgttattatccaaagagaatcatgtaaattgtgcaagtcaaattacatgtcagagaatgtggtgatgtctgttcctttttttaactttcaggaactgataattccaagaacatagtttgtcagtgtgcacagggttcttttaatactgtaaacccttccataaaagggccatatatttatttctatatcaccagcaaccaattgttgactttataaggaaaatagttgatgataattaaaattttgaatctacagtcatcatatatttcttgttggaatgctttcccaaaggattctcagggccagatcaaagtgtgaatcatttttcattatttatttttatatgtattcaacacaatcacatgtatgataggcataagtgttaccatggcagtctcctcattggaaggtgtgttaaaaggactcaccagagtgagggattagttttattaacagttacaaattcttagtgtagtctagtagacactgcttgattccaagggggacgagctctaggcaggtcctagaggaatccatgggtaggttggcttgctgtctgactcctgagagaggttacacagaaagctctcttccccagtagtgaaaatatagcaatatgtgagtgacctgtgtgaccgtcttgtccatggaaggccagtagaaagttagttccccaagttcttttagttgttgctgttttactttgttttcgtttttggctatttatataggtgctcagttgaacttttaggaaaaatacagattccccaatacaaagcagatcttcatcattaagcattttatttcatatcaatagacatagtgaccctcactttaatatttaggaaacctgggatatattctacatcctggtttccacactattaccaatagccaacattataagcaagccttacatacaggatagtcttatacttgttctgtgaacttttttggcagcatggctttgtgtgaatactatcgatggtaagagaattaaactgtagtgtgtgacattttttttaaaagtactttaaattacactcatatgcttaatctttagacagcatgatgaaggtctcaggttatttattagagatgtctctaatgctttggtggtttaagtacctgttcattgacttgcattattgctgaattccttagttaagctttatgagtacactaaacatacctgacttcctgctgccctggctagagctttacagcttgctaaaaatatagttgcttatactccatgtcctcttgcaaatatagtcagctagacatactcttgcttgatagtttttcttagagccatataatattatactgacttttattcagactttaaatttctttgttttggttggtgagttgggctattcatatggcagaagctaagaaaacaataaagcaaagaaaattagagagttccagaaagtcttggcatgttgttttaatttcacatattctgcaatgttaagatcttaatttcagccctgtgaatgtggcgtgtgtgtgtgtgtgtgtgtgtgtgtgtgtgtgtgtgtgtgtgcgtgcgtgtgtgcgtgcatgtgtgcatgctatctctcagggattcgcatacatagatcagaaattatggtcttaaaattgtacatctctatctatatctatatctgtatctatatttccatggtaattgatagaaaaccatctttgattactgctttgtgtagttttatgtgctaacatgtttgctgatttcaaggctttacatgaatgccttggggactacaattacggcagttccatatttggcgtagctccccccttttttaaatcaggaattctgttttcaaccatttgcaacattacttgccccattttctgacttaaatttgggacaagaagacacttaatatgtcttagtgacttgcggatgtcaactcaggctttcacccagttaatcttatgatttgagaagaaaaaaaaaagatgttattgacagtaagatgtgacagctaacagcaaaggaagaactataaaaactatagtagtctttagttattgtaccaagagacaagcagccccactgttttcaatggttttgaagggcgttactctattattacaaacactagaaactgatcttgctgaggtgccatcaagagaagattcattatgctctccagcagtatagcctgtgtctactaccttttataaaagtttccatcaagattgcttctctcccttcccttttagttattttatttaaaaacgctctcacatacagatcatacatttatggatcactgggtatggggaatgaaagaccccattgtacttggttctctttatgaaagctcatggaaaaataggtatccttgatttccttagtacttaatataataaaaagcatgcataggttcaactacagagtaatgatgccaagtgaacaagtaaggattgcagaaatatttggtgtaatttgggacacattttttcatgttctctcatgacttcacataaatatttatgaggtttattttcaaaggaaataacttgctacctgcaagattgtttaaaaaattattttcatgaggcatggacatcttaaaactctgtaggaaaatggattgtgcttcagtctagaaattagataaaaggtcccttaaccctggtgggaggggaagcatttttttttttttacatattcccagaatgtatgtttctggtgagctggcagtgttttttatgacacaagagaggaatgatgtctgtttcattatacaaaagcctgtccctatcccagcctgtctgccaggcaactctctggtaatgtttcctgacttttttttaaaactgtgttttagggattgtgataaatacaagtttttcatggatgatctcattctgtccttattgtaagtaatcttagaaggtgatcattattatcttcagttcaagaggttcatatttacaacagggaattataatgtccaaggtcaggtgtgcctgacagtgacctattaactctcaattgttctccctgtctaaacgcccctcctccccagcactttggtaagacagcaaggtaggcttactctacttactataggagacagttacttatggatgttagaatatgcaacaaatgcaagctgactcttttttctttttttggcttccagtatgggaaactccctgtcataaatgaattgcaaactattatcccttatttttaatcaccgagctataaaaatgaggtttttggtgatatttactagtagtctccatggttttcttgccacgttctcttctagcaatatttgattgcttatttgcagacagggaaccagcttccataatgatagaatgcactgttgttgtttttggtatctttggcaataaaggctgaaacagcaacctccaccccaatcacaccacgtccaaacaacagcaaagtacaaggctttatcttgactccatcatttgcaaaggggtcaggaattcctgcttctttgtttttaccatagtacacgtttttatagctcaaatatatctttctgtgtagacttggtaattaaatattttggttagcatccagttatgccaacaacatttgttgaagatgctttcttttttccattgtataattttagcttctttgtcaaaaatcaggtgttcgtgggtgtgtggattaatgtcagggtctctgattcgattccattggactagccaatattaagctgttttgattattgtagctctatagtagagcttgaagtcaggtgttttgatggccctgggtgttcctttattgtacaggactcttttggttatcctgggttttttggttttccatatgaatttgggtattgttctttcaagttctgtgaagaattgtgctgagattttgatggggattgcattgaatctgtagattgttcttggcaagattgccatttttactatgtagatcctacctatacaagagcatgggagttctttccatttcccagcaattctatcttaggcatatacctaaaggatgcacattcataccacaaggacatctgttcaactatgttcatagcagcattatttgtaatagagagaaactggaagcaaccttaactgaagaatggatacagaaaatgtggtacgtttacacaacggagtactattcagcagaaaaaaaatgacatcttgaaattcgtaagcagatggatggaactagaagaaaccatcctgagtgaggtaacccagacacagaaagacaaacatggtatgcattcactcataaatggatattagacagaacaacggataaccagccaacaatctataacttcagagaagctaggaaacaaggaggaccctaagagaggcatacacagatccccccagaaggggaaaggaacaagatctcctgagtaaatatattggttaaactattttaatgggaaaatgtaccagtgtttttatttttgtttgtttgtttgtgtttatgttcagctgatttacaaacagatttaagggtgtaatcatgtaaactgggactgcttgtaaaacataggtttggggctacttttactatcagattagattgaatattcttgttaatttgaatcttgtgatatgtatgaaagtgtacactgcagttagtttaacacttcagttgttataaaaggataatttcaatagtatgtaaatttaatgtaactttggagacttagacttagtttgttcatttcaatgttaatttatttaagttttagctattttaaaataggtttatgtgtgtgggcctggtaatgttttttattttggtttcattacattttgaaatgaaagtgactttaaattaggctccaaggaggtgttagttaaattattagtaatgagtttggttgctttgaaaaaagcatacttgtcaatgaataaacataatatactgaagcagaattcctttataatgtggctgttacagggccactaccttttatgcaaactagttttgttacacacagtgatagtttcagcagcaataggattttactgaagataataaaaattatttttttagcaattggattccagtttataccatatcctggcttcagttagaggaaaagacccttgcaagcctgtttttgaaatcttagaaacattgatgaatagaaagagtttgctctcccttgtattccattttcattttgcttcccattgtgtatgctatgatgggtgttcatttggcttcagtttttctttgtatttgtatttcttcacttaaacaacaatgcattaacatacgtgtcatactcattgtataataaaaacaagaaacgagactagaacttctcccatgtgttacctttcttacctctgtgatcaaattcctgaccaaaagcaattttagaaaacggtttattttggatcacatttttagaagtctcttctggtggcatgggttggcagtggaggcatgagaggctacttaatttcaccccaaatcacaaagcagaaagagatgaataccactgtcccccctttcccctttttattcagttcaagacaacagcccatgggattgtgctgcccacattgagtatatgtctccaaacctcagttacccccaaattcccttacagatactcagagatttcttaggtgatcctaaatataaccaaccaaattgtcaatcaaagctaactatcacaatctattaaacatcagttggattttactgttgtgggcatagcaatattaagttttgtgtttggatggtatttttcattgtcaatcactagcatattttcattgtctttcaatgacaagctatagaaaggtatataattttcaatagtccatagtattgcttagtgttaggaagttggctgatactccatcttcaaaaatataatatcaaaaccaaaccagtaccacaaccaccaccaccaccaccaccaccaccaaacctagaggtccatttgatgtgaatagagattctgttttagcttagtttaggggaaagaaaaatagagctgaaaagcatgagagttccaggagtttggttgcaggtactattgaaaagaagaaagaactctgccccctgtcccccagctcctctttccagtgtcctttttattaacactcttgtagaacttccaggaaggtgagtaattgtcctctgtttctttgggaaacgatcccatacattctcccaatctataataattgacctaactatttctttgcttttaggtttctgtagatttttttgtttctgtagttataactataaaaaatagcttttatttgtgtaaccctgaatacccactcaacttgaacttttacatttaaatagaaattctaagaccattgatcttcctgtttgatgacttctgatgactactgtacaatctccagtccttgctcatagcctttattttccatttttattagagaagtagaaattaactttgtaaaaggctacttgctgtatgtgcccgccctttaccctgaattcatttaatcctcccagatttttgtattcagactctttgagatgaaggaaatgaagattagatagatagacaaaggaacttacctaaaacgttgtggaaggaatcagaactcaaatcctgatctgatatcaagtccctggtttgaccctgcaaaaggatgcttgccattcttgtattcttttgtcacattcctctattcatggctaaagagtgagttattgatacaggaaagaaaatattacttgaagttaaagtcttgggaatttactttactctgctgtcaccccgtagccaacataatcatttcacatcttaatgaaaacatctatgtttcttgaatagaaacttcagtcttttctgttgctagccataccatatgttattttatcagcaagctaagttatgtcagaaagttggaaatttagagcagaaaaaatatccctgttctcaactcttaactaggggattataaatcaaggctaaggaaaaatctgcgggtgtgttattttgtgcttttatatatttttatgtgcaaaacatagcagtaaggatgctaaaattatgtggtagaaatggaatctcaattcttaaccaaatgtatagtctgctttagagaaaaaagatgtacatgaaagatatacacatgcataggcatatacacatatgcttgtgtgtgtgtgttttcttagtcatcttggactgtgggaagaaaatgcaatatgttgtctggttcaatgataaatatttttttgttctagagtatggagagtctagggtcatgatgctagcacatatggtttagtgaagaccttctcggtttatagactgtctacttttcagtgcctcatcacatagcaatgttaagaatttttgctatctcttattttcctaataagatgaactaaatttcatcaccggtactgtacccaaatgacccaatcaaaagataattgcttcccaaaggccctaccttctaataaatcacattcttgtttgggtttaacatacaaatttttggaagacacaaacattcaactgtaacaggtgctttcataacataaataatgtttgagtatattaaaaaaaacaatgtggtggactgtaaaatatttaagtgccatgcttttaaaaaccagagggaaactgttgatataagacagctggtgagttacaaacacagagaaacaatatgttgttcatatatctgtaatagtttattcagacttctgtaacaaaatggcacaaatgatgtaacatcattgacagaaatcgttgctcgtagttgtgataattagaaagtccagatcaaggcttcaacgaagtttttggttactgaggactcaaagatgtttcacagatgacccatttttgcttaatcctcatggtagaataggtaaagaagcccattttatgtctgttataaggatactattcccattaatgagagctccatcctcttgaaatagtccctttcttagtggtccccaactcttagaagttttaccttgagagttaggtttcatcacatgcactgtagcagcacctcaatgctgagtagacccagacacaaaggcttcagttaaggtatgttgaatggatgaattttaaaaaatcataaagtatcatttctgacttggctgtatcctcacaggtcaggtaaaaggaagagttgaccagtttaacttcattaagaaacattcaaatagcaaaatattttttgttcaatccatggcaaattcaaaataaggaaataattcttttttcctatgaaggtataagttgcatccattcaaattgaagctggtgtgaactgcagtggatgtaactacaccctgttataacacgtgtctttaatatgtgtatattagttaccctcatttatgggattctatttgctagtgttggccctaacaggcagcaaaacaatggaaactcgttttcttttggttctgaaggccagaagtagctgtaagggaaaatccattttattgtgtctggggagacaattcttgtctctgcttccaacttcacattgtcttatgcttttcctgttgagactctcctcttttgtatctttaacaggattagttctcatagcatttatggctcgctaacatagtgatagattgatgtaaagttgatctcattttgagatccataattacatttatggagaccctttggccaactaggatcacatctgtaggttctggacataagcaacttttttttgtagatgctattcaatctcccacatcagctgatgtttacagcagtagtacttgtgccgacctccatgttttctctttggtcttataggagtttctgctaggtagggggttgtttcattagcaccacaaaaaaacaaaaaatgatggaaattaaataaaagctttgttattttcatggatatgaagctagtttcatagtatggcctgaagtctgttttgtttaatgttgtagatattcctgaaaacattatgttaaggtctgtagtcagtttaagcattctgtatacatcctttagctatcatttggtaatgtacaagtcattcactttcttactgattttctatttgcctatcagttattgaatgaggcataatcaagtcagtgaccataattgcagatttacctgtttgtcctgtagtcttattggttattgcttctggtttttgaaaacagttactagtcttgtatatatgtaggattatatattacttactaaattaactcattttgccctcctgtacattaaaaagtacctaataaaagctcatctattggtttattatatatgcttcttaattatggctttcaaaggttacttttgggtggataatactgatctttaacttaaaacaagttagcttttgttttgttttgtttttcaagacagggtttctctgtgtaagagctctggctgtcctggaactcactttgtagatcagcctggccttgaattcacaggatctgcctgcctctgcctccagagtgctgggattagaggcatgcactaccactggcaggcataataggctagtgttaaatggtgttatttgcctttttttggagccttgcctgtctcctgacttttgtattgttgttatgtattctacttgtatacctgatggtacattgtattatttttagtcatttatgttttaagaaaaataaacactataaactaaacatggtagctgcatgcacataggctgtgcacatcccaggatagctatgaatgcagtcttgcataattgtagaaatgaaaacattatattccagtgccaaaagtttggatccttctgttatggtctgaatattattacatacttcacttttaaatgcaccctactataatgctttatccctttatgtgggctttcagtatgttcctgatacctactttctttagtgtttctcatagtacaaatatttatgcattggattttgcattgaatatttgtattcatctgtactgttttcaacttaacctttgaaagacatttcactagctacaaaattctaacatattttcttttcttttcagtgatatgttttccttagatccttgaaatatggtcctgtgttgatttctttctggctttcattgatatgaatgaaaagtcagaaatcatttttaggctccattctcttctatgtaacaagctatcatttctggatactactcttctattctcatcctacatgcttttaatatttttgttaaataactgtaactttatttatttacagtgctgggatcttactcaggtcttcaggaatgctagggcaacatgcccccaatagccataccttaagcctttcatttattattttttcaagacagggtttctctgtgtagctttgtagaccaggctggcttcaaactcacagacatctgcctgcctctgcctcctgagtactggcattaaagaagcctttcattttcttttatgaaaagtttaaatctgtttgggctcattggatttttaaatttctggattaatggatttttatcaaatctaaaaaagtatggttcattatttcatcaagtggttggcctatctatctatctatctatctatctatctatctatctatctatctatctatctatctatctatctatctcttcactttgctagaaaagttctctatagaagaacaatttatatttttatttctttattttattcattctattttgaaagtaatattctgctcatagttgaggctggcttcaaatttggtatactcttgcctcagcctcccatatcctggcaaggtaggttgttctcacatgctaagctagaaagctgatttgtagtgctcctcctttcattaaggttctcctaagtttttaaactttcctttccttttgtgtggtttggattgatactttccatgacccttattttcatttcactcttttcactactgtagtgtatcatctattaaacacatacattggaatttagttgcaggtggggcattatttccctgctctatgattccatatttttccagtttcattcctcttaatagtatatacattttctttaaatattaaagtcacaaataatagctttaaagttcttgcccatgactttacccttatctctgtctgcatttatttccactgactaacttcctgctcatttggaaatatattattttttctctagctgtgggatataggaatatggtattgttaactattagaagttgcatatttttctccctctcctttatttttttggtgttttgagacatgatatttctatgtagccctggctgttctggaactcactctagtccaggctgaactcaaactcggagatctgcctgcgtccgcctcccaaatgctgggattaaaggcgtgccgccaccactacctggtcctgaagttatgtatcttaaagcatgtctcttgtttttctaagcacacttcagatttaattcagggcttggtaaatgctgcaactctatatgaactaattgcctcaaatagtaaatttctattatatgcccatcagttaattttaagacttgttttaaagctttgcttgtatgaatctaaaataacacttgttctatggctaattcagttgcactcttgaagtgtggtgtttttctagtttctaaagcagcagttctcaaccttgatattgctgtgactctttaatactctttaatatagttctcatgttgtggtgactaccctctaccataaaattattttctttgctacttcataactgtaattttgctactggtaagaatcataatgtaaatctctgtgttttcccagtgatcttaggtgaccccctatgaaaaggtcatgtgaccccagaggagttgtaacccacaggttgagaaccactgctctaaaggcttggtgagatctcttcactctaatcagagcacaaatgtctcagccctgtgcgaactgtagtagttgaatttattattctctgggagccatttgcccatttctaatggagtcgcatttatatttgtgcagattgctagtcagcattatctcaagtagactgtcttgcctgtctctagtagtgttctctggtgctatgcttcataaatcaaagctgcgccattctccctggtctcccatttctcttttccagctccgccgcagtactgtgcttcgtccttaccttgcactgcactgtggaaaatacacacacacagcctggatcactggacgtctggcttagtttgtttccattctctcagggatcacagccctctgcagcctgttgtctaatgtctgaaagcagttgtttcatgtattttctctgattttctgtttgtttacagttggagggctagtctactaacaggtacttgtttatggccagaagtagaagtgcctcgtgtggttttttttcattgaatgaggtgtgtttgcttgttactctttaattaacagactgttgaattggtgttcatttgttcctttaatgtcacactttaaaagtaaactttcttaatgtagggacaataattacatgtcccactccgccacccctgtgtataaatctgtgagatgatcattcaagtttaacctgtcataccatttagttttttaaaaaagatgactacatctatgagagatgtctacatgctgaatttgtgtgtagtctctttgaagtagaaagaacattacaattgtgacctacatttttttccactggattttcttcactgatagctaagtgttttgatagagtgtaaagcaacattttattagtttctcaaatcccttgctatcctctctttgcagaatgaaaatttcaactctttatgtcatagtggggagtatagaatatgaaaatataattgtccatgtctcttaactgcaattttaatttgaatagtctcacaagatgcatttcttttctccaagaaataagtgaaggctctttggagttcagagctaaaattaagcgctcttttaggtcgagtccccaggacactcagtttttcattctaggcagctctgtctcatctttacatttcctgtgttgtctctgtagatggttagaaaagcaatacttcatcaggttgctgccagtactcctctgtgagatggttattaaaagcatttcctttcctcaccaattcagagtgccaggctttcactgatcttatatactcgagctcttctgacacaagagagagggtagctaaacagctctcaaagctgggtttatagcctttcatctaatttggcctttcagtgaactaggtaaggtggttctccatctttctctacctctctgtcattaatatggttgatcgttgcaaagagctgcagtcaaacaaaagtggaaacttttgtaatttatgtatagctttaaaaaggcaaagaagtgaaggattattgcagttggtgcagtccccaatacaattaatatcaaatgcatataaatcctattagagatctgtcatgggtgaaaaaggaatatgaaaaatgcgtgacctatctttattagattcggttagagagagaccatacagagctaaggagctttacgaactgcatattaatcataaccagtcttctgagataaacctatttcttgtaacttatcaaagccatacagaagattagtcattccctttggtcaaggaaggttttacatattgttctgagttttgaacatcatagcttccaaaactgattaacagatattctaatactaactagatattgaattatatagtttagacagctattatcctataatgacccctcaatagggagatgggcactttgtcaaaacctctgcattattgttttgttgcaaggaggcactctagggagttgtattagacatcacacaaaagaactttgctacagcaagccatagttaaattgtgcagaaaacacttctttcttaaatctttattttaagcaacaattgctcgatgccggccccatttttttaatgtcattttcaattcctgaagtcttttatctcgttgagaaggaggagaattagctcaaggggatggttaagaccatcatgttcatgcactgtagtactgaagatagtggatgtagaacagctatagtctgacaaagataattaagactgtattttaaaaatgagacgaagagagcaagagaatttcacaagattattggactttttagatagcatataagcgtagcagcaatgcattgggttttgttttgttggccctaaatactgagcaatgttgattgtcacttaattaccctaaatgtattaggtaatgctgacaaaaacagacaagtatttaacaatgaagatttttatatttaatgatgtactattttgtagctttgattttgcatttccaaaccccaaaaaagttttatagaagtatgtatagtgaaaaaattcactcttctcatcctatactataaggatgactaattatgataatccctcttagtactttaagagccgatttactgatgaaagtcatagaaagtggccccataataaatctacagctccatgagttatttcaaaatgtctatgtctgtgccatgaacactcaatttaagaaatgaacattgaaatcacttctcaattcttttgacctattcaaatgcaagcactaatttgctttacaatactcgtattttcagctgttttaaaatttaacatcgaaaacatccgctttcatggatttgtgatggcctttcctgtgtttcatataattgaaattaaaaatattggtctatacctgaagttagccatttttttctagaaaaggatagatgctaaatatcgtaggttctgtggcacattagtctctgtcacaaacattcaagttgactgctgtagatggtatagaaatgaatggtatagtgggagatttcattgtatgattagattacagtcaacaaacccattgagctataggcgggcatttgtttttccttttacctggaatactcttacaacatatgttgttgttattattattattactattacagtaattttattttatgtgcattgtgtcttgcctgctttgatgtctgttcaccaagtgttcatgtggtgtccacagaggttatgagaaggttttaaatcccctggaacttgaggtaaacatagttttgagctgttatgtggttgctgcaagaagtcaaaatgctgttagtagctaagttatctctcaagcttcataacatttgctcttttatacatcaatgtgcatttctatttggcatatagaaattatatatcatagggcaagcctaagttcaagtaggaatgttgaaaacttttctaaaaccatagattaattgaatgctccaccagtaaataaacttatcattgcttgtaccaatagtgatttttccaagatattttcctgactaattagatattagacagtatataatgatgttttcattttaatgtcataccattagtaatcctgaatattaatgtatatttggtcaaatcaaaagaaagtgtggaaaatcttatataatatggtagactctgatttaatcagttattcttagtctcttaaaatctccatagtatgtatgatttctagagtgagctgatttttattgtcaacatatgactgatagtaccattagtgtagtcgtagagaaaaaaggagaccatgcacatattaaatagcataatttctgcatacatcctctattaatggtcttttgaatgttgtctttgaactttattttagagtctaaacccaaaaagtcttttctcaaatgtttacctcacactttttgatattacttactggtttatattctctggtttcttatggtcatatctttcggccccaataattttgcctgattcctgaagattttgttcaaaggatgaattttctaccttgcctcaatgcaccaacatttttatctttagactttcaactaactttgcagtcttaccatgtagaccctaactctcatcaagttaaaatatctaaagtgctcattcatacactaagaataaatactggttccactgtcagctttgggagcccctttcctgaggcaggacaatctcttagcctagattcactggggaaggcctaggttctgccccaaatgatgggacagactttgatgattccccatgagaggcctcactcctccttgaggagtggacgggtggtgggataggggattgtggggggagtgggaggatgtgagggagaggtaactggaattggtatgtaaaataagatggtttttaattaaataaaattaatttaaaatatctgaagtaaatttattataatcataattgcctgtccatgtcttcccatacaatcaccagatcaaagtcccaacctcccagattcaccatgtagcaaacagagaatctagaagtgttctgttaagcactgaaaattagcaaataataaaataatttctttccattggttaaatgaaaggtgagtgaaagcttcacattttatgtcttttttttgtttgttttttttgagacagggtttctctgtattgctttggagcctgtcctggagctcactctgtagaccaggctggacttgaactcaaagagatccacctgtctctgccatcctgagtgctgggattaaaggcatgcaccaccaatgcccagctttatgtatccttttttaggaaaggaattgttatattctaaatatgaaatactatgaattttaatatttgttctataaatgtaaatcattttacaaccataattttggtagatgggcaagttaattatagattagagaaatgtagccatagatcattctagttaaagaatggccattgttcaagtctttatagtgttcctaaaataaagttataaatacatgctgaaatttaaaaataatttatccaacataaataagtcatcattatcatcttgaaaaagtaattgctttggataataagaaaaaaaaaaacatgtctttcgaggcagacactgataatgctccaagtttagcttaaatcttttgaggaaagcgtctgctttgtaagattgttactttcaaatatggaagccattatctcatggagttggagtgtcactgaaatactttatccttcctggatatacaacctagaacggcatcacaccaaggtaaatcccctggttgtaattatagaaattaagcaaaattgtaagtatatatttggccctttctgtattttaggtgtggttttaacagcttgtatttagatttcaatggggacagacgtaaaatgcatgtacacacacacacacacacacacacacacacacacacaccacacacacacatcaaatccatgtgcatacacgtaaatgcatgcatagatgaacatacaacttacatgcggtattgtctactttaacagaaaacagaaaattacactggggtcatatacagctataaccaatgaaatgcaatttttaaaattaaaattctgggtgttgccttccatagtgggtcttcagaatctgtcatatcctttgcagtagtgtctagggccacccccttgtgcctaggctcagggaatatccttctatgtggaatgggctcccaaagtctattcctatgctagggataagaactgatctactacaaaggccccatagatttgaggtctcctcactgacacccacgttcatgggggtctggatcagtcctatgctggtttcccagctatcagtctggggacaaagagttccaacttgttcaggtcagctatttctgtgggtttcaccagcctggtctgaacccctttgctcatcactcctccttctctgctgactaaagggtataggataggtagggtgttagttgtcaggggggtaggggaggaggggaggcagagggaactgggattgacatgtaaaataatcttgtttctaatttaaataaaaatggagagaaagaaataaaaaagacagttggattgttacttacaaaactaaacatactcttatcatatgctcaattgggttgaaaacttctgtccatgcagacacctgcacttaggcctggggatgtgatttagtgggagagttctcacttgcataacattcaggaagctctagtttcaatcctcagtattgcaaaatcagtgagagacagagacacagagacagagacattaaaacctgcactcaatgtttttggcagctttctcttaaaaaatactgattttttatattatatgaattggtgttctgccagataccagatcccctggaatagacagttgtgaactggcatgtgggtgctgggaattgaacctggaagagcagtcagtgctcttaaccgctgagccatctctttaaaccttttggtagctttcttaataattgtccaaacatggaagcaacaagatgtccttcaatgggatttttagtgataaaaagaaattggctttcaagccataaaatctgaaaagaccacatattgtacaattataattatgtgacacacttcaaaaggcaaaatatgagcacagcaaagaagattaatgctgaggggagagggatagatggacaaataagcagagactgtgaaattttaggagagtgaaaatattttgtatgaaactgtagctttgggtatgtgatacatttgccaaaagtcattaggtaacaatctaatgtatcagcctagttgtatgtttatcaattgtcttagggtaaaacaattctgggtgttcttacttgaatctcgctggtggattattataatagaaaagagaaaaataccagcaaaataatatatatgtaaatgggaaattccacagatagatcagaatactatctgtggcagaaattagtaatattagctttttaaagaaaacaatcaccaaaccttctctaaaagcacatctgtatttattccaatggcaggtgacaacagtggaacaaagagctgtcttttcaaatttcacttcctaagctttccgtgtgtctcagttacagtgatggtgaataatggagaaagtcagcacaagggcagattctgcgtaattggaaaagataatttcctatactgtgtgatttgaaggccacactaagatctcatctaccatcctctttccataactagacacacccacaattattccactcaacagataataataacattaggagtaatatttctaaacagtcactattacaatacctatacaatgctttgcctagattttccataaaccttcttatattctctctctttctatttatacattagaaggtagtgctccacaagaactcggttcaggttgaaggtgatgagaattttcagtctgagtcagattgcatgagagctagcgcgatggtggcagtgttctgttctgaacgcctgtgtgacagtcacacaaaagcccaggcagagcactttttcagagtggattgtttcttccggtcatagtccttcatatcaccaaaggattcaaatgttactgtgtcatccttagctataatattcatctgctgagtggtttgcacatacagtcccctcagatatgatgaataaatgtaagcagacttaataaccactatataggatacctctttgccatagtccattctttgttccagctttgctcaaatgaagcctatttcaaatcatccctttggaaattacaatcttccctcacgacacttcctgtctctctcagtttttgtccatagcacttatgcctgtgaattttgtctataaatataaatctatatgtgtgtatatatacatgaatatatatttatgtgtgcacatggatgggtttttgtgactgtatgttttctttaatctgtcccctcttaaatgcacactgcattacaaattatttaatgagaatatctcattattcctagactgtttttcttccatgtcataactgaagagaaacctccttcttccaaaataaacaacttgcctatttcagagtagcaatctgtgtttgcactttttaatgtggttagcatgtgagtattgtgccccaaacacatatcatgagatctacacttttaataatgttttaagtatgcaaaagaaaattgattgctgtagatgcattgctatacaacatattttcaaagggttttcatgtagcatgactgaataaaatcactgaaaatgaactcctttttgcttactcattatctagcacccacggttctactttctgctttgattaattgattaataatttgactgatttgggtacatcctgtaaatggtaccctatagcaattgtctgtcagctaattccagttaccataatattctcccatttatccttgttatagaatataacaggatttccttttatgtggctgaataattttctattatgtgtttctatttaaggaagagactattctttctccattgtgtattctacttttgtacaatattagttgagtttatgtgagaaagttcatttctgggttctatactgttgctttacccaattttttttaacggcaataatatcatcagtctatatttgatttatattcctattttatataccggcataactggcactgtgtattgaatggaaaatgttggcacttagagaagcctgttgtcagagggatatctgttagctgaatgatgtgaacagattagccatgtgaataggaagtctctttcaggctaagaggaaagttgaaattaatttaaaaggaccttaacattagaaagacattaacatggtgacagaagaggaagaaagtcggtatgattgtgaaagctgtttgtggaccatgtgataaggatcacacagttaatcagaagccaggcctatttggccaatgtacaaattgatttaaaagtgttgttttttcaaatattaggatatttgttttgttttatcctttgctctttttttttcctccgggtgaagctgtagagctgactaacctttggcatgagtttccatctcagtgtctcatgtcttcacatgtggtgatacagagtgctttgtgacggacctcataacagagtccctgtgcagacaggagtctagaactttctcatttgctacatgatatgcagtgaatgatgatcagatcatgtctcacgtctactgagtcaatcatttcatgtctttgaagtcccatagtttcttttctactggaggtgaaatctgtgacctccctgtggacgcttggccccttagacagctgggcatttagatgtattctgtgcttccaatgcatacttacatgcccctgacaaactttggtttctaaattaggttcagtaagaggttaacaagaactaagagtaaaacagtacatctgtaaaaactactacaatacaggtggtccaaaatgcacaaattgcttattggtatgacttttccattaagcatttcatagtgctattgaacttgcatggctgaaactggaaagcacaaatctatataatggagagctgttattaaagattgaaattataggagaaacactgaaaggaatgtatgaacacttcttaatttttaatgatgaattctttcaaatttcactatggttgaaatgtaacttttcaatattaagtctagtatcactcatctttccatcattgtgagactttgtgtctctatacatagctttttgtagtcttcgaaaatgagagattggatgtaactgacaaattttctgtcactaatacttgtactgggtctgaattttgactcttaaaatgctattttcactctaaaaacattttaaaggtacattgaaatttttcattctttttatttatttatttatttttgagacagggtctctgtgtgtaacagccctggctgtcctggaacctggctggcttctagcttacagagatacccctgcctctgcctcctgagtgctgtgactaaaggcttgagccaccaccaccttgcacttaactctttttctaaggctttgtaaaccatgtgtacatacaagtaagtctcccacactcaaggctcacaacaggcaaaattttcttgtctctttcagatttctctgtcaaatacattgttttgactgcttttaaacatcatgatgtataacaccaagttgtaatttcttagtcatgactgtgcaagtttctatactactctttgttagattgcatatagatcataaaatacatttaaattttctgaaagacagcctggcttggtagtacatatctttaattatgggagagagaggcccgtagatctgagttgagtgtcagcctggcatacatagagagttccaggcccaccaggtctacatagtggaaccctgtgccgataaaggaaacagaatttataaaagatgggaattggggacattttctggctttaagaatccttccgattcctattaaatggtatttatattgtaaatttatctcaattatgtaaacataactgttatgtaatgacagcaatcaaaactgaagaatattagatctcattttctcaatgatgtgcttttctctacttaccttccaagtaccttcttgcttgctgtcgactgtacatgtgactaaaaggaagctgagcctagaaattgttccctagtactgtttgattaatcagaaggtgccagttcaagaatagtttagatatctttgagcatacattgtaatatttattgtatggaggcaaggagctaaacatgctggtattcacaacgactgctgcttttgtacctgtggtaatgacacatttcagagcaagagagcctgaaagtttaccttctgctcacttcagaaatcattaggaatattttaaatgatcaactcattgctggaaaatcaagaaagtctttggaaaactagaaatagattcactttatcatacctttctccatactcgtcagagcaactgagaggctaggtgtgaaggtaaaattgcacacaaacacacacacacacacacacacacacacacacacacacacacacactagggagaaatccaggtaaatgctatttgattggaggctacaaaaggctttagaaaaggagaaataaaaatagaagtgttaaaagaaaatagttcttatttctagtctatatgaaaggggaccttttgtaaataatatgcagtattgaagaacatgtggtgaatttgaagcaaatttagaaaaaatgataatataggaatacctttgtgtatttgttgttatacagctgaagaaattaataccctaatagtggatgatttgtgagacagtgcatttcttgaaagaaaattgtgtgtgaaaatagaagccatggaaatgtttataatgacaccccaaattctctttctagaaaaatttcccaaagaaggaaatgagcaaaaatgatagctaaggatatttaatgttacatttttctcatagtaaaaaaaaatctaggttttaaatgagttaagaagtcattacatgttaattgataaactattacataattgaagatattctatatacttaattgtatgtgatactttaataacatattgaatattttacatttatgtttcttagtgttttgcaactatatatgtctatataccacagtgttatggatagttgtgagctgtcctgtggatgctgggaattgaaccctgtgcaaaaacaagtgctcttaactgctgagacagctctccagcccctttcattacatattaaacagaacacattaaacagaaaatgcatatagtatgaaatcaattaaaaatattttgcacagggccaaaaaggatagattatgtgacaaaatattaatagaaattctcttcagatgagaaaacatggtgacttttatttttgtattttgtgttaactatattttctaaatttcccttaatgtacacatattcgatttaaaataaaacaagaggaaataaatgataatgtacttagattgtattatctttattttctcataatgtttatgatatagcaattacaaatttaataaattctccatctctgtctttttttttgccaagggagctattatttaaattccatttcattcagaaaacaagaaatatattttctattttttgatgtagtggaaagggatgaaggagctgttaataagttcagatataagcaatataagtatgttcaatgtgtatcctattaacttgaagggaaaacaggaatctgtgttccttgatactttccatctcatagccttattgctttcatcatgtctagttttcaatttaagatgcaccattatattagtaatttatttcaactttatatgtgggatgttgtatttagagaatctataatgattgtcaattcaaggggaattatcatttagaaatagtttttgggtggattttgtctctttttagtagactgggaaagtaaaagcaatgccttctaaggggaaatagtgcaaacagatgaaatttaactgagcactaggcatagaaaatagaagagctcatgtgagggagattctatgttcttaaatgatgaactgtttggaaatgagatggtgtggtacagatgtgaagagtaaaacagaaacaagtctggtagctggtaacatcttcccatctgctctttgtattacaaataatagtcccattgtctaagttcatggcaatagtgcttcaaaaacagacaaataaatgcttcatagtgttatctttggcttatgtaatctggaagagatgataacatcctgtgttgttgtaaaggaccagtagactggattaatttccctacagatgttcttcaggatgtttcttccacatttttggtttttctcaaaagatacatctcatgagtgattcaggaaaaatgccagtggatttgcatttgtgaggaattgagtcctctaattatttatggaaagcttaaaaatgaatgtgtaccacattttacaaatggatgctgcatgccagctagcacaattgtattgcttaggtgcctctcttaatgagaggtatttactagtttggtaagtgtttctcatatgtaatgacagtaaaccttcccttcttccactagtagtaaatactttctagtgtcttccaaatcagatgaaagtttcatttcaaaaatctcaaaagcttgttattagatgactaccttagctttccttatttttttttttactatttttttattgcaaactggtggaaagttggaggtagaaccaggttgaaaataggtccttgagcagtctttgtggtctttctctctcttctagcttcctggtaaacaatgtgagcaccttcttgcagtcacatttacaacatattggtgttctttgctcttgcccagttcccaaaagcagtagagctaactgactagggactgaatcatctggtacctcagccaaaatgatagttccttctttataattacttttccccctcccttgctttcccttattccctgccacttcccctccttcctacattctttttatctcaggtatttgtagcagcagagtactgagttacaaaaaaaagacaccactaaatgataaaaaatggaacaatcattatagcatgttaatatcagtttgctagtgctgagtaactgccatttagggcagagtcaatctgtgttcttccatataaactgagcattctctctcattcagtttgtctcacatgagattgtcttagactagggtttttcaatcttcctaatgctgtgaccctttattataattcctcatgttgtggtggcacccaaccataaaattattttgttactacttcataactgtaattttgttgttattatgaattgtaatgtatatatctgtgttttgtgatggccttaggtgacccctgtaaaatcatcttttgacactcaaaggggttacaacccacaggttgagaaaccactggcttagaccaactgagatggtatggcacatgactgatgtgacagcatattagagctggaatacatcgtttatcccaatgtgacctttctcttaaggggaagtatcttgcccaagtcatagagctggataggcgaaagtagaataatgcaaattattggatggaaagaggtagtatttggattacatgggggaatgattaaatgtttgaaaaagaatagttattaatgatacatgaaacataatatttttattaagcccacattttaaagagcacatttggggactaattttcttacttcaatatttgcataaaaatagaaagtgatgtattaaaacagaacatttccaggaaaaaagcaaggtatcagctaatgtatattaatcaatgagtgtattcatggtttcaatccatacctataaactatagtttctgtacagtaacctcatttagttttcatgtttctctgtgtacttgtgtcagtaatatgtaaatgtacatatgtgtacatgttggtgcatttgtgtggggttcagaggtcaattttggctgttgatttttctttgcaacagtctagggcctggaactcactggttaggtaaggctgactagccagtgagccctatggtcttcttgtctattttttccaaggactgagattacaaatagacaccaacacacatggctttttctatgggacctggagagcaaatataggccctcataattgcacagcaagcactttatggactgagctgctcctcagcttttttgagatgtataatacttttgaaaacacctgaatatactattgttgagcaagggagaaatagctaagaatttagagagagaaaatgaagatctcgtatagcatattgtgaatagcaaagtcgtagtgttaaggatgctatttcaaaggacgattattgtatctgttatattctattaaaccatagtccaagttaatagaccatgtaaagttaaaacaaaaagaacaccttaaaagaactggaaggagaatattcaggggaaagaaaaagaattgtttgagagggacaaagccttcatagaaaaaaataattatgtctttccaacatttttagtgttaaggaccctttatactttcaaaattattgcaacctgcaaagcctgttctttgtatcatttatgtatcttgaaatttgatttaaaaacaagaatattttagaacacaacactacagaggaacatgctctatttacaattagaatagctgtggcatcccaggtcaggtagcctctggaaaactaatgcttttctcgtctctgcatttctcactgcatcagcttcattttctcttgtcagagggagatttctttgtctggtaggggtcttagttattaccagcagcaagaacatagtagttgtgtttggatacaagggttcaggtgatattgttataaatggatagaggagttgtttggttggtaatggagtgaatttttccatgctataaccttctttcttctttagaaaatcacagtacacattgtcatgatacataatttgaagtaacatatgatagaatgcttaattatctgtagttaactcactacaccatatcttaggtgatgtcattacacatatttataagtatctcacaagacactagtatcccatgagtgtgggaaatttatttcatttgttgtaaaattttaattccatttttacatcatggagatttctaatcttctgctctactccccttttcatcatcagacagattgttgtgatttatgagaataagaaagagaaccatagctatttttgcaaatatgtatgtgtaatttggtgtaatgagaccatatttttctgaagaaaattatttaagtggtatgtttgggttattcatgggagacagaaaatcaaatatggtaacaatacttcagtatgtattagcaaaaggcctatgatatatttcatgtgtttttaataaatatattaatataatacaaaaataattattttttcatgataaatgtagctacctgaaagcaatatagttattatgcatactgagaaattacttaattaattccctttaagatcagaggcaatatcttgatgtttattgttaccagggttaccagtattgacccatttccctcttttcctgaaaggagaggacaacgtgtatttgccactgtgattagagaaatatatactttataaaggaatacataaaattatatgaatagctgataatagatataaaatgcataacaaatagcaccctaagcagtcattaacaaatgtgagtcttatttattataacaataagaaagaatcactatcaataacttttctataggattatttctagggactgacaacaagatgtgaaattttcactgtttgtttgcctttcctttaatggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgacataaccttttctgaaaacctatcacattgccagacgtttgaaatgcttcatgttagtgtgatggagggagacaagctctgtgtttttcttagcaccatctttctttcctgttatcattttagagggaaatttcatgacaccttccaaaatttggcgcaataattccagtccttgagattcattccctgcttttgtcgaatgcaaatttgtgaagatgtatgaacaagaatatcagatgtaatcttgtccctcagtagtgcattggcaagccacgtcttctttactttatctttggttcagggtgctgcagccacactaccctttttaattcgggaatatgccaggtcatttccactcctaggacctttgtactatcagatacgtttggttttaatacttcttcccttgtcttattccatgcctgactttttcttgtttttcaggtctcaagcattacttccttaaagatgctgttcctaacttcccaccataaagtggctccacatagttctctgtcaaaatgtggtccacatagctattactgtttattgtttactttcctgtttatttgctgtttttctgaaaattggaagagcaatatacttcgcaattaaaggcattggctgtaaagtcaaggctgggttcatgtcctggccctgccatttactatctctgagcacttggggacaatttcagcttaatccccatatggttcactttccttatctgtaaaactgtgtaagaatagagcgtatcttacagacttgtgagaattcaatgtactttaacatctgtgttacttactttctccttgctgtgataaaatacctcacagaatcatgttaagggaagactggatttatttcggggcacagtttgagaggaaagagttcatcatggcaaggaaagcatggcaactggggcttcatctgtggatcagggagtttgcagcagctgtttgtttcttggtaccaaaccaagaagcatagagggtgggtggtggtagagagttgaattataaccctaacccccccttgattattgctcttcactttctctagttaggcgcaacctgctaaagattctgcagcttctaaaacaatgcctccatttgtagaccaactccctgaaaagtcacattcaagccctagtagcatctaaacccattcaaagcactagttttggtatgttagaaaaaaactccaaaagatacaaatgaccaagcaaacaaaaacagtctacttattgatccagcaaattagaataatcactcatcaaagtgctattttggaagtgtctcagttaatgaggtagttgggcatgtgcagatgagaatctcctttagaatttgctatcagtgagaatgacctagagcatacttcaaatctcagtgtcacagctattttctgctaatgcagcatgccatcatctgccactgaaggtctctggctcatattatgctcatacaggatcttatgctctacatatagcaaaacgaagaacaagacactgaatgacatcttactacttatgttaggaaagaccatccttcacttatactcatgttgcattggctacatcagagaactacatctgatttgtttttttttttactttggttatttgctgtattttttaaaattaattaattttttaagcattctaatcccagttccccttccctccttccctcccattcccttcaattcccccttctcccatctgctccacagagatggtgaggcctcccctagcaagtctactaggtctgtcccatcatcccgttgaagtaggacaaaggcatgtctctacccccacacccctgtgtctagactgggcatggtatttctccatatagaatgggctccatataaaatttgtatattagtgttatgtcttggacccactgctagtgaccttatatattgtctcagtcacaccattatcacctatataaagggagtttagtttgttcttatgcaggttacccatttgtcagacctgagtcagtgatctcttaatagctcgggtcagctggttctgtgagtttccccatcatggtcttgactcctttgttcatatatttgctcctccctcactttgattgtactccaggaacatggcccattggttagttgtggatttctgcatctgcttccatctgtttctggaagagcgttcaagcttctctggggttatggattgtaggctgggtattttttgctttatttgtggtatccacttatgtatcagtaatactgtatttgtcattctggttttgggttacctaacttaggatggttttttctagttctgcccatttgcctgtgaattttaggatgtcattgtttcttactgctgagtagtactccattgtgtaaatgtatccaatttttttttatccattattcaattgagggacatctaggctgtttccaagatctggctattacaaataatgttcctatgaacatagttgagcaaatgtttttgtggtgtgaatgtgcctccttccttcgggtatatgcccaacagtggtattgcagggtcttgaggtaggttgatccctaattttctgaggaaccaccacactgatatccacagcagctgtacacgtttgcactttcaccagcatctccagcataagctgtctttggtgttttttattttagccattctgatcagtgtaaggtagaatctcagagtggttttgatttgcatttccctgatgactaaggatgttgaacatttccttaagtgcctttccaccatttgagattgttctgttgagaattctctatttagatctgtaactcatttttattgaattatttggcaatttgctttctagtttcttgagttctttgtatattttggacaccagtcctctgtcagatgtggggttggtgaagaacttttcccattctgtagggggcgcattttgtcttgttgaccatgttctttgctttacagacacttctcagtttcaggggttcccatttattaattgttgctctcagagtctgtgctactggtgttctatttaggaagtggtctcctgtgcctagctacatctgattttaaggaggagggaaacacaatcctgtcctcttaaggaggaacagcagaaatttgggtgagtgacactttaacaatattaggaatatattaggaataaaggtacaaagtaacaagaatagtttcattggatgtatataccatcatgcatcatttaattactgaaatatggcattatctggtcccattgtcctatgaatattctatagtattcttagacaaacctagacttagacttcctagtgtacttatttttaatgtattttctttctatactattttgatttttaaaagctaaaatgcaaaaccacactatcccaggcctagacaaggtcaatttaatatcaacatctaccactgtgacctacttactgttctcatggaaggctgataggtgaataacatgtataacattcactgtctccactgccaacagtgccttctcctagattaactcctgaaaatcctgcttaatgttgttttacagttaacttttgattaataagtagttttcagtatagtaacaataataatatattatagcagttttataatccatgaatagccacttcttatgtattttacatccttgtatttgtcgttttttcatacaagtaggattataataggttttcttttatatcaagattaccacaaacattagcaatacattatattttatatacctaggtgataagttttctagtctattacagtcttactttccttttttcttttggtttgatttttgccagagcttctctcttagccctggctctccaggaagtcactttgtagatctggctgacctagaactcagagacctgcctgcctctgcctcctaagtgctggaattagaggtatacatcaccactgcttggccctttatagtcataatgggatcaccattatatatttagggtatccttgacagacctgttagacagtatgagacctacataaaatttttaataatttttttcttggaagtgtataaattacaagtgtgtgtgtgtgtgtgtgtgtgtgtgtgtgtgtgtgtgtgtgtgtcatctacttgtgtacttgtgtatatgcatgtgcatgtatttagtcttactatgtagcccagttatgctagtcctttctttgtagcgcagcttagattatagatatgtatcacaatgcctggtgaggcatttgtcttttacattataccctgacatatgctttacttttgaacattcacatattactttcatagctaaaatacaattgtttccttactgcctcatgtatactttggtaagaggtcatagcaaatactattacagtttaattgaggtgggatggtttgtaatatatatcaaatacagaagtaactaatgtaacaatgagtggtgtgtacagggtctactaagtgaatttttgaagtatgattatcaatgtgaaatttaataagtaaaataattctttttatgtgtgtgtatgaggtgtgtgtatgtgtgtgtgtgtgtgtgagagagagagagagagagagagagagagagagagagagagagagagatgatgatgatgatgatgatgatgatgatgatgatgatgatgatgatgatgatgatgatgatgatgatgatgatgatgatgatgagtatcaaagcaagggactcagacatgctgggcaagcattctaccactgagatacatcccatttcaagctcaatgctgaagggtgaaaaatggtagaagaggttaatatgccaaagtttcctagtaacaaaacttctgggtagttaattgaaaagcctgtatgagcagaccacagaaatatttttatatcactttgtacttggatagtaatatgacatgtagcataatatatttctgaataaatatttgcgatctttgcctgaccttataaatttgttcctggcagttattccagagcttttcttagctcagaagttttagttttcgtacttcttggagagtaaagtattaaatgatttttaaatgataatgttagaagttttatttaactgttcttctcaagttactttgatagaaatatagacatatggttgtttataacctgcaaataattggagaagtattcttgtcggtagagatcaccgtcctctaacatttttctgtagtgtcttagatatatacacttgttttccttggtattttattttttatttgttgaatacaaattgggttgtatcatgaagaagtattttgaaataggtgtcatcgtcttccactcctcaagcttctagttattttgggttttcttttaatagctgcttgtgcataattaatgtttaagaaaatgaccacacattgatgtccacatacacatcaaaatcaacatagtgaaaaaaactcatacacaggtttccagattctcttgaaaaattacattacttatttatcttgtagttttctatgtgtacatgctcgtgtgggtgcggatgaacatgtgctatttatgcaggtaggtgtcagagcaaaccttcagggagttaattcgtgtcttccacaatgtgtataaggaataaaaatctcaagatatctttatatcaaggaaatttacattttactgctttgctctgctgagaaatagatgtgacacttcagttgtacattaaaatgtactcttgagaaagaaaaaggaaaagaagttttataaatatagtcttgagaaaactgatacaattcagagcatatatcccagaaattaagagaaataaaacatgattatgaataattattacatggtaggctcgacgtgcttttactgtacaaagtgatttcatgcgctccacaatgagtctctgaaacaaagaacatggtctctcctctcttttgtggctcctgggggaggctgcacaactgcattaaaacccctaaagattgctgttttgcatggaaattcatgtttgatggttttttttactttccctatgagaagcagctaagggaatttggtaatcacactttccttatcttatcaggtctaaagttaaatcagaaagatctatagaaggatttctgttgtacaagaaaggtggtgtgcaaacacagtacctgatcagcgagctagattttgtaattgctccactgttgttgatgatgacatcttacccatggctatggtaaagaccttgagagccaggcagcaatttatgctctaaattcttgcctggtagggttgtataatctaatgatttagcaaatttttggtatcaagagtttacggtactcataaaatgctgtttggatatggaatgaattttctcttgataaatgaccattctcaaaggcatattgatttccatataattatatagctacttatactttagtttattagcaaaaccgtctcagattttgcataatttaatgaatataattaatgactaactattcttcttttctctgataggctaagtaatcaggctgacctagactaattcttcatactcattacagagcaggaagggaggaacggcaaagtgttattttgcatgatagctctgtttttctcaacttcctattacagacattattaattttatttgaagcagtattaaaggtatatttaaagtaagggatagagatattataggtaaaactgagaaaaaataaaatacacatatgtgatgtatccttttccttacattttcttacatgccaaaataaagtaatttctctgagacgatattaattagtattttaggcattttccattttacctttaattactttttaatttaattaggtaaatgtggatatgaaaatgtgaagtatcaggcatgttaggcaatgacagatttccaaatgacctttatacatatcttcacagtttaacatgtttacatattattacatcctgattggtgtgtgtgtgtttgtgtgtgtgtgtgtgtgtgtgtgtgtgtgtgtgtgtgtgtgtgtgtgtgtgtgtatctgaaagagcagctacaaacttccaggtaaaataatgagtcctcaggtttggacaaagtacagaaagaaacccaacaaatatttaatcattgtaactccttatggattggacctgagttcaaatctcccagatttacatgaaaggctagacatgactacatgtaaaaacaaataagcaattaatttcttaatggagagaagcagagtttttaatttctcttacactgatatagtgtgcccagaagtatcagctgctttaaattttgattacatttctttaaataaaatgaggaatggactttggttataaaattctatgctacttttaagaacgaatgaaacttagtcatacacacacatttcaggttagtttttgaaaatttcagaaatgtatacaaactatttattccccttcaactcttccctggccaccaccctccaccccacatcctgttcccaagttcagttcttcttttatcattatgtatacattgttctgatgtggttactgggaattgaactcagggcctctggaagggcagttaatgttcttatcctctgagccgtctctccagccaccccaaggtcatctgttttttaagtttggtaattttgttttttttttttttttaactttacacatgaccactggatctacgtcacttcaacctctactccaactcctcctgtgtcccgactttcaaattaatgaatgaattcttttattattactgttacatacagaaatacatacatatatatgtatatatatacagatatatatatatatatatatgtacacacatacatatacatgtatacactcacacatatataatatatatacacacacctatagctaagacaatttggagttcccaagcctctccctcctgcctggctactatataaacccccttctctctcttctctgagtctctccttctctgttcttgtcactgatgctgctgtttcagaaagaaggaggggcccgtgttaacttgagtccacttatttttttcttgtatgtacatgtatacaagtttgaccacttggaattggacagcctatgtgggagctacttcttgaaggagactgattctccatttccaagcaggcattcaacacaagtagatcaacatctaggggtagaatgatgtggaatttccctgtccatattggcaagtcaactggtattgtcatggtggtcttgttcaggtaatcatattattgagagggaagctgtacctgtgaactctcaatttcttcctggttcctttttcttttactttttttttttataactcattgtgtctaattagtgctgcagctcatatactcatgggtgtgtgccatccacttcagcattgtcaacttaccagggaccacacccataaataaaattgactcacttctctcaagaccatctgccaatatttcagatagggccgggtcttgggtatccctcctcaatgcatgctgtaatgttagttttgtgtaagcaaacacagatgatttgggaattcatgagttcaatacccctgtcatatttagaagaattttttcctctagtcttccctgaactctgtcttttccttcagtgatattccttgattattgcgggtagaaggacatatacctagaataattgtgttaattggaaaagatcattgtcagtacatcaaaactgtgaccattcttagattttgtatgcatgatttttaaactttgttttctacaatacaaatacaatatatgttaagccccaaaccacaaacctgaatcataaccttgagatccactctaatgcaaaaatagagtctttattcgcaagttaacacgggtccctccttctttctgaaacagcagcagcagtgacaagaacagagaaggagagactcagagaagagagagaagggggtttatatagtagccaggcaggagggagaggcttgggaactccaaattgtcttagctataggtttgggatttgctcaagccctccaaaattgcatagttacagccttgggattggctgaagccttccaaaactgcatagttacaaccttgggattggctcaaacccgggtatctggactgggctggttggctgcactgcgtctagggaaaattgcaacattgttgtctcataaggcaggcacctggagttgtttactcatttctgattggcctcttccttgtggtgaggtgttgctggtttctggtgggcctccatgggctagggtcagtggaaagatagggacagtcaggcttgacagattggaagaggctgcttcctgctaaagtcagggggacagggggacacctcaaccaggggctactactttcttagattaaacatctatggggagtgttgctcccacactagagtgtactacttccctaagctggggtcaggaaagggtatgcctctagacttgaggttactattcccctatctccctgggctggaacgttcacacccataggctgagggtaactactttactgctcagggattggttgattttccctgctcaaggattggctggttttctgtcaggagcaaaaatggctgtagtttcagggccaaactgtgtttctttctgtggttctttttagctgttaggctccaattttagggcctgggagaatttttttacaggttccgattctaggggcaaagtttattcttttagagttagtttcagagatggggtgtttttccctggcgctagatttgcaaataaagtgcctctttctttggctcaggcccggaatctaggatgtgtttcttttactcggttgaggctctggggctagccattcaggaacagtgtagagtctaaggatcagggatttgctgggacctgggtctcatatattttcctactgatcattaattcttatcaggcaccatgctactactatttcacatgctcctatttaccagattccctcattatgtgcctggcagtagacactataatcttcaactttcaagttgggggattctgactgcgaatttaagtaagctacccagttagttcctctgtggtgagcttggggcttattttgaactcaagtaatgtttctgttgagtacttgtgctggtagtaaatcttgatctttggagtgtggaaataatctttgggaatagcaaaattttttggctttacatttgataaatgagcgaattgatcatgccctgcccttaaaatataaagcaatgagatgtatatttggataaactatccccggagataatttcttcatccaaaaaaggcttttcaaaaactgtttcagcagtggcaacgtaattatagtaagtacattgcccctgagataactgtggtagacagcacaactttgaaagattaaggtctgtttgttcacaagcaaaataggcttcttattttatactcagattttgtgatggcagagtaaataactttcgtgtcattatctaattgtatacattgttttaagagatagaaatattgtagtagagtacaaaaccacaccatttctgttagtgtgcaacgtttgatcatttctaagggaaaattacaaaactatttagctcacctcagtttctatagcacagcctctaaagtctcatttctttaacagggccttgtgggtgttctaaaggaatgattgaaatgaaaagaaatgagagagtcaaacagtgtactgtaatagatgaaatggaaagtaattatgttaatgttgactcattatgaagccctaaccgtttgtacctgctcatttctgtgtggaaacctgtgcagctgagatgctgaataagaaattcttgtataaatgagcctagaggcatgtttctaatattggagctaagcctatgcagaattgtaatgaatttccctaagtcagtgtttaaatgtgctatcagagaatgtgcttctcttgacagaaaatttggattctactgtttaccatcaaaattttacctctgtgtttgaatcctaatagctgaatataactatcatttgtaaattgggaggagagaaaaattctcaaattgcacaatatatctgtattatatgcagtgtcagtgtcagattttctaagatatgctcatgtagacatacttcagataaattatacagaagagatgtatgagataaagttagcagggcaaaaggatgcaggtgagtataactttgcaaatatgtatcctggaccccttcataaggaagcagttgtaaattactcaagcaatttgaccacagggtgtctggtgtgtttgtgtgtgtgtgtgtgtgtgtgtgtgtgtgtgtgtgtgtgtgtgtgtgtgtgtagaagttatatctatttacatctttgatgatatatgtggtgcttaagaacatggcatttggggttgagccaactagatttaaactgtttgagtccagtactgaagcttttgttcagtgttagagaattattgtgtccattccctaaatgcttcagtctccccattgtacatgaatgtttctcccttcctataacatgttgtgcaagcatttgcctttcagctatagcttagtattaaatgtccttaccttttataattcaaacgagtcctgtctttattccagacataaagtattataggatctctgtgagttgttaccctgccaattctggtttagttacaattgagaaaatggtacattgctatttgtaatttaaagagacttaattttacctctgtgccagggagtatcttcaaaaacagtgaaattactaaaacaacgagacacctgatttttgtcaaattaggttcaccattaacttgagattttaattgcagcaaagaatattttactttgggcatgaacttttctttcttcttgtcagtccaaatgcttttaagtaatccacttaaatttaattttctcaaaatgagtgttgatgctgataatattcttttgcatgtagaggtaattaatatcaggttggtattcagtgtcactctactttgtttggatatctgcttttagatttttgcattactccgacaaagatgcaagacctatttagactttaacagtgaagtcttagcatagaatatcctaccagaaggagtgtaaaaatttcatctgcagcagagctgtctaaaagaaatacaatgtaagccacatatgtaatttaaaaatttctagaaaccacatttaagaagtgaaaagaaatatccaaagttcattttaataatacggtttatttctatatctagtcaatgtaaaattattgaaaagatacatcacatcattttatactaagtcttcaaaatctgctgtgtatcttatatttatagcacatttcaattccagccttgctgcatttcaagtagtaggcttctgcctgtgaccagaggctacctggtttggcagtgtagacctcaagtcctgatttattttctatccccatgttcctgatgaaatgatacactaagaatagtgctagcatccttcctgtggaggagggcatgcttgtctactaaggcattatcagaaaaatcataatttgtcttactgacttcctggttttgtacacgaggaataaagactagattcattaaaggccttttgttttgcaataagttgattctcatggatttctttctattctgaaatttcttttccttttttgcttgctcattttagagatgtaattttcctttgtttcccatgacatgtaagaatggagatcatttatcaaaaatgacaattgtgctgatgttgcttcttggacaatttttatttactatggtgagtgtgtttatgtatgtgtgagtccaacttgtgtgtggtggaacaaaggtcaggggacaggtttccagagttgcttcttcacttctgttgtgaaatctgaggattgactctaggttctgtatgaggtttgtgcatcaagcactttttacctgctgaaatattttgccatccctgtgttgtttcttttagtaaatatctgaagctcctgttatagtttggagagaggttgagagtgttcaccagtgattcatgtgcagtagccatggtcctcagcatggttatcctggaaagttgtagtgacatatataagaggaggaccttaggacatttgagtacctgctcttataaagaaagttcttttattttaaattaaaaaaatatttttcactttacataccagcaccagttcccccttccttatcttctcccaccccctgcctcccctttctcactcctgccactcctcagagtgtgtaaggccttccttgtggagtcaactaagtctgacatatcaagttgaggcaggaccaagaccctctcccctgtatcaaggccgagcaaggtgtcccccaataggaaatgggctccaaaaagcacattcatgtatccaagataagtcctggtcccactgccagggatccccaaaacagatcaagccacagcactgtcacccacattcagctgtcagtctagtgtctgttatttcccgctagatagggtcagctgtctctgtgatttcccccatgcagctcctgatcccccaaccccttgttcatatgatcccttctctctttcttcagctgatctccaggaactcagcacagcactttgctgtgtgtcactgcatctgcttccatcagttactggatataggttttataataacaattagggtagtcactaatctgattaaaagggaaggcccatttggacagcctctccattgctaggagtcatagcagggtcatccttgtggattcccgattatatctctagcatcaggtttctcccataccccataatggctccctctatcaagatatcttttattgctctctccttccttccctcccccaactgtgtcttgattccttatgtttccatcacccatcccctcccagttaccccctctccccagtttacccaggagatcttaactatttttccctcctggggctcttcatgtgtgtccctcttagactcccctttttacctagtttctctggggttgcagattgtagtcaggttatactttgctttacatctaatgtccacttataagtgaatactttcactcaggatgtttttttctagttccatccatttgcttgcaaatttcaggatgtcatttttttttctcctgagtagtcctccattgtgtaaatgtaccacattttctttacccgttcttcaggtgaagggcatctaagttgtttccagattctggttattataaataatgctgctatgaacttagttgagcacatgtccttgtggtatgattgtacatcctttgggtatatgcccaagaattaaagttcttatggactctagaatgagttctcctcaataccatgttcttacaagagcaagatctctggtttgttttgtcagcatgatgacaccttctcacatgtcttcctgccctgagacctcattggatgctgaaccaaagctacttgatctgtagctttcaattttctttgtaaacatttcctactaggcttaggtatttttacatgaaaatgaaaaatagtcaaatgcaatctctatgttgttgaagccccagtaatcatttaagctacattctcttgaaagttccactaatcacaaccatttgctttgcattttgaacatgaattactcatctaatctcttgatggaaaatcatctcctgtcttctttactgatttacaatactatataggtcttttgcaatgtgtgttctattcatatacatagtcttgccttctactttcgtgctgtttaaaattccctgttaaccttctcatgtgactgttcattaggacaaattgggaaaggacttgggactgaatgaaactggattcttctttcgttgaccttatcctaagaaagagaaaccagagtgccatcctaagcataaatgttattaccttgttgattgtttagtattattttggaacaataagacatagtccttagcagcttagttgtacaatgcatcttttcactatcaccatttgtcctagtattcgtccatactgaacactttccacaacccaggcatttagcactcataatttcctagtgtgctgtaccatttttccagtgttcatcatttcattttttattaactgcccctttccatgatatcctcttaaaggtacagtctcaatcctgcttcacataaagcccctcccttctgttagaatactgtttcttatgtcctcgcaatgcttcttctggtatggatttcttgtatttcctgtggtagttctccatctgttgcttttctgatagtaaatttgtaggctggatataagcatactatattgaacgcagttgcacctttggaaataaatgggaattggttcgggattcctaactgagcagtcccatatgtgaggaaaatgacacatattaaataccaactaggtagtttgtgtacatgatcttatgtagtattggcaataatattctataggttgtggagtgcttccattttagagaggaaatccagctttgtaaagtgattgcattatccatttcgcctacttagtaaatatcatatttcaaattggaatccaagtttgaatgaagaatgcctccttgtatttaaatgtacacatttaaggggaagatatactttggtgggtgtagaaagcaatggtctctgctaactgacagggatgataaactcatgactagtattaaagtataggcacttcttgaaagccctacttcctttcccaaagtttgtattgctgttttcatctttccatgttagtgcgtattaaactttgtaaaagttacgactgatattgtactgataggaaatgtgttttggtaaaagttgactatacaggtaaaaacttgtaaattagcaaaaacaaaaagtggaattacactttcctttttgaaggcagcttggtgattgagaataggctaagagcattgctggcagagaatattaggcatcctcttccagtggatgtgtgaaagcttttgctacttagcatgtcaataatatgtcgactggaaagggttttacaaatatctgagcacatttgaaaaggtatataaaactagcattggattctcaatgcagggagtcctttcatcaccctgtgaggttggttaccagagatttgtgattgaggctgcaagaggctaaatcactttttgaaatgacaacataagtggcagaagagcatttaaatacattcttctctaacttcctgagagcatacaatccttcagatatgccaagtgagtaattttggtattgttcctgtaatatgtcctattccattaattatattatcaggcgtatttcaaaaactagtacaaagatggatttcagaactgttctatcagtaagcagagaagatatatattcacaattcttggtgacacatactaaatgaaaatgcattgtagctatttaaatcaccataagtttttcttttcagttatgttaaagattcacataggtataatggcttattttttcatgaggcaaagtagcttaaatgcagaatttaaagacgtgatcgacattatgacatgtcttaaatagtgttaatattctttgctcagttaatttaatcctttttaaggaagaagactgtatttttgactggcctttagttaaaaggaaattataaacgtcattctaaattaaatctgtgaatagtaaagtatttgttgatatgtgtaatatgaaggctgaatttctagatgtttagttggctttctttgtctagttgctaaccactacactgtttggtggttgcttgatttttatctggattgtagagcatataaactcaaataagactaggagatttctgttgacatgcagttttttcctagggaaatttactgcatactgcagtgggaatactatttcatatcagtgtcctagccctctcttacacacccattcactgcagacactgaatacaatattcagtacacacaagcttaaaagctagcaggttttaacattctagttgtaattctgtggtagttatgaaatatgaaaaataatgttttaagatttattttaaaacactttggtaaggaaaacatatttcctcttagcttgtcattaatctgggtttacatgtgggctggccccacttatcctggaggcagttaatcattaaacatttttagtggcaaaaacctctccttataaaaagatttttgtcttcctgtcataaatttttcatacttctttccagattttaaactagaaaatattgtaaatattatgggatagcattatgatttcctttcaaactgcagtggaagatgccttgttgtaatgtgtcctttatacacagaatattatttattagtcgataatttgtgtcttcagaaatatttaattactcatcactattcaaatatacgctggatacatttcaaattggtgaccgaattaaaataacattggtccttttagcccaacctaaatctaactactaggttgagtaaaatcaagctgttaataaattcaggataatagccaacttggtgggctttgcctttgatagttgggaagtccatgtattgctgaactactagttccaagtacatcagtcaggcatgtatgccaaacctcttcaaaacacattaccagatttattccttttattcaaccatcctgactgggaagaacagaaatggggaatgctccttagagccatcaaggatggattcttggcaggtcttaagctgatcagctgggatgatcttggtttgtcgaaaaaaaaatggaggaatggtttactgaagctgattatgtgttatagttcatcagggcattttgttaaacttgtgcagcagaatgtctgcgtttccccctatgtgatagaaacagcaaatggcaggctctcactcaagaatcagtagtgggtgtgttctcagaagccaagggaagtgtctcagcccttaattgtccttagggaagaagtttattgattctatccttgtctttagataagcacatcacagcatacattatccagactggtagtgccacaggctgcctggagccctaatggagaacatgtgtctgacttgttgtcatatatcaaagaaggacaactatctggcagtgcaccatggggtctatccaggactatgtctccaggaaggctccatgttccttcagtgagaggatatagtcattcaaggtgtttcacctgatctttcccaaaatgtcaggtgggatgccttgagccacctcaagttcctctattactgtacactgggttatgtcttctgtgcccctctgcttccatgaggactcattggaccatcattgtcttcaactggtgtcctccagtatacacatagctatgattgtcagggccactcaggccatggtgttgccagaatgaagcagctgaagttggcgctgtctcaggtggaacagacactacatgcaccaatgtgggagactggaaggctggaatgctgcaggaacccactcaggtggcagcttatggctagctttttggcatatataccaaacccataggaaagacaaacttgctagctacacacatgggagaaaccaaaatttcttcttgatgagatgactcacaattatcccatctttctcttttaaagccagtaaactagaaattattgcttatgtggaaagttgtgcctttagcattcatagtacggacctggatatggcaaggatgtttcttatatttcacctttgtgtttgtactttaattttatttgaaatgaactgtaaagtcaaccagaaatacactttatatttgagtatgggggattcctggtgctggtgaccagcatcagttaatgcatttaagccttgagttttcacagtagcactttatatattctcatttgagtagctttgagtagttatgaagttttcaatattaaccagtttagtttgacactaaagtcagtgtataagcatattcaattctgttaacattcctttagtttttcattttacacatgtaacaaagcaagcagtgatgaaatattcaaatcttatttatgttctgcatttaaaaatataggatcttcaatagtgcagatattttctaattatatatttagtgcttttcaatagtattttttaaaagtctaatatgtaaaatgtacacacacatacaaatgcacacacatgtctctggtagtttgactgagaattcacttattgtctcatatatttgaatgcttggctccccagtggaactgtttgagacggattaggaggtgaagctttgttggaggagatgtgtcactgggagtgagctttgacctttcaaaaatccactacaggcctagtgtcacactgtttgctgatcaggatgcaaatctctcagctactgcaccaacaccatgccagccagcatgctgccatgatccccaccctgatgataattaactaacactcttgacactgtgaacaagcccccaattaaatgctttcttttattataagagttgcccttgctcatggcgtctcctcacagcaacaaaacaataactaagacaacttaaccatattggcacctgtatttaaataccctgaaatctgtgtggaatcacaattgacttgatatagcaaacttgacttctgcaaaatagtacattttgctcttaagctggacagttcttgtgattgctaaaatgttcaggtccagtggaattataaaaatgctactaagccatcattgagagagaattttctatcgtagttgtagctcttatatcctttgtcttgtccttcctttggtgccgccctcctacctctatggttttctgatgcttcttttgtgtgtggaaaggtaatctatacagataagtcttacaggaggagccacatagttagttccaaataataaagaaaagtgcttatatggaaaaaaattagatttccatataggcccagaggagtagatacaatcaaggggtaattatatgagatacatttcatatcagtaaaagaattaagtaaatgattgctagtctactatgccttgattctcgactgactgccttaaacaacactgaatggagttaaagcaaggcactgaagaatagtaacaaaaatatgtgacctttggaaattgacagatctatgtcacatttttgactctattttatttaaatttcagttaaaatattgtattataatttcacacatgtttaccataaataataatcactctcatctcccacctctctactactccattttcccctttcctccccccagctctctttctaacattcatatttcatgatttttgttgagtgacccaccaagattaaccagggccacctatgtgactatggatgtggagctgtctatcagagactagtgggctcagcagaaggatacacagctaaagtctgtgttttcctcccttcccagaatctatctatagccattagttcagagttaaagggtagggaccgccccccttccaccttgatttattgttaataggcctggttttgtgagaatccagtgcagataactatagctgatgtaacacaaataataaaaatccattcagatattatggttcaagatgaagatcagagaagcaaagaagccagcttttacctccatctgaggctgaaagggctgatctggctccaggattcctcagaggcaaatgctcttcctgtctgttaactaaatctccacatgagaccctttgcttcttccttttatacctcctagtgttgggattaaaggcctgtgatcccaagtactgagatcaaaggcatgaactccattactcttcactcttgtgtagaccagggtggccttgaactcagaaggattcatctgcctatctcctgagtcctgggattaaaggtgtgtgccatcactgcctggctctgtagcttgctagtatggctgctgagattaaaggtgtgtattaccacttcctgcctctatagcttgtggctagctttgcattctgaaccttcaggcaagctttagtaagtcataaataatatattatcccaagatgatgttaattaataattacgatagctgtatgaagtctagggaatgatagttcttagtccatatctagatcttctaacacttaaacacttccaacttccttttccttaatgcttcctttgtctctacttcttaataattgtgtggctactagtgattcacttttgcctccctgtctctaatgttggtgacaatgcttatcttgcaggttgatataaaagtaaatacaatgtgcataaaactcctttacaaagtggttcacacatgtagttactcactgaatagcaggccctggcttttattttatgcactttatgagtaatcaaatacttaaagttaggtaagttgtgctattcttaaccatttatctcatggatattcttttgtattacttttagaaatatatggtttaaatgttttgcaaatgccacctttaccccttgcatctagtagatgacagattacaggagagtttggtttatataactctccaaggtacatagtgagacattgttaaaataaaacaataacaaaaacatgtggatgacttattgttaccctcctctctcatcatggtatggtatgaagttagtaacttaaggagagaaaacaggattgggcccttgttcttccacttctcagtcattttaaatgaaactggtacttaccatatggagatattatttgattttaatggttatgccagatgctattttgtcttcttccactaacctgagatgtataacttgaggctgtgatgcctgtatattggagggcatattccagacctttattttgacaatacctaacaatgtgcacattttatagcagaaaattgtaaaaagattgtgttgaatcaatggataccagctttgagctctttgacaatttgaggcattttgatccttttgaaagtgaattgaccatttactaaaaccagtcaacattaagcttttaaagtaattttcatgtctgcattactgataattcttttggggggaaggtagggaatagagaaagattatgataaatgcttttaccttagcctgcctttttaaagagagtcttaaagggcagagcctcttggttgagagacacttaaatgataaatgatagtgacaacatttgtttttcctcaccagagttttggggatcagagcaagtcagagagactggtatcctaaatcttagcttctttaagtgctaacaactgtcatttgttgttccctgaccatcaaatattttctggaatattatccatttataactatcacttcagataatggctgtttggttttgtataatgtacttttaaaggaattttgttctttttaaatttaaattagaaacaatcttattttacataacaatccccctgctccctctcactcccattttcctatgtcccctgtcaacccctgtcccacatccactcctcagggagggtgaagcctcccatggggaatcttcaaagcctgtcatatcatttgggtcagggcctaggccctcccccatgtatctaggctgagagaatatccctccatagggaatagattcccaaagcctgtttatgcactagggataaatactggttccactgccagaggccccatagactgcccaagcctcccaactgacacccatgttcagggggcttgtttcagtcccatgctgtttccccaactatcagacaggggttcatgaacttccacttgctcagatcagctgtttttgtgggtttgtccagcacggtcttgacccctttgctcatcactcctccctctctgaaactggattccatgagattggctcagtgtttagctgtgggtgtctgcttctgcttccatcagctactgagtgaaggctctagaatggcatttaaggtagtcatcaatctcattatagaggaaggcatttaaagtagcagttccactattgctaggatcttagttggtgtcatccttgtagatctctggatatttctgtagtggcacatttctctttaaacccataatggctccctctattaaggtatctcttttcttgctctcctactctattcttcccttgcctagattaatcttcctgattcctcttgttctcctcccctctcccttcctcctccctccctccccatcaacccatgctcccaatttgctcaggaaatcttgtccttttaaaggaattttaaaagatctttaattttttaaagcatgattgttattctcctaggtttctcacctgtaggggatttcctctgagatgcatattttatgtaatagagtgagcctacacttagtggtgctatcttattttcttcttcagtatttcctttaaacacgatgctttcccccctactctcatttatccactgtctctatttacttacctgttagtttttgaaagaagtacagatatttggtaaaaatttttgttaatatatggtgaagttaccacagcgttggaatacttttggattgaaagttaactactgccccaaactgtctgagtctgtactactttcacttagaacacacaattatccaagagaatacaataacatttctattgcttgatatttaagtattcttttagtgcccgggacacacatacaaatgcagaatatttctttacaaaatggagggatagctcagaaatcaagaatacttgctccccaaaaggtcctttggttccatcacccacatcaggtggctcacatcttcctgtaactccagatctaaggtatctgattccctctactggtcttcacaggcacttgcaatatctgcacatatccacacagaggtgtgattaaaacacatctatcaaataaccagaaaatctctttataaaataatgttatacatcatgaactcatatatgacattttctcattttctacttcagctcttccagtgaaataacacagaaaaaaactgtacctagggattttgtgttaatttcattattggagtttgtatttactaatttttaacaagattcttcttgtgtaataactaatatatccatctggatcaaatacttttaatgttttatattacattatattactattaaatgtattagtattatatattatatatagtattgttatgttgtataattagtatatatagtagtattataatgttacataatacacttccatcagtttgatcttctatcttagaaaaatgtgccatcatatttattaacagatacagtttacaaaagtttagttagataataataatagtagttacttttgatgctcatttactatgaaataaacattgttctaattgttttgcttaatttacttgtcagaacattccaaagaaggtgttttctctaaaccaaagaagggagaatttaagcaattttctccagattacatagctgcctaggtgatctcgtctaggtataatttctggaatccattccttaacttcatgtgaccgatccattaatcttactagaattgttttaagaagtgtttgtcttgtagttaagtgactttttgagtatatattcatgatcagattacagaaatgatgttgaatctattacttttaggggtttctcagagcttctatgaactttgagttgtctcatcttcttgacatgattgggaaacattttctttctatcaaaattgttccttgtacagctgtagggaactgggattctaagtgagctctgttgtgagaaaggtagagaggaaagttaacatacttgcctgagttgtttctcctaaagaatagaaattctgatggattaagtctagaagtaggttgggagagaatctccaaatgcctagagatctgactcctcaccattttcatttttttttctgccaacacatccaatatagtttcattgaatgtgctttacgtcatccctaaatcattcctgatacaagtactacatttggttcattatcctctagtgaattatgtgtttgataaattgacatttctgtaactgttcctggagagttttgactgcacaggagttccaatgcaaatggaagatgcagttttgccagtaacagatattaggttttttaaaaaaagcttgctttaattaattgttcacatcgaaaaacccatggatgaccagtgttgtcttgtgcaaaagataaagaggggtcaagttttttattaaagtacttgtaaagtctttacaccatgctgactgagcctagccaccggataggacccccaaaacaacacacagagacttgtagggtacaatgctgcaggccaatgatcaggatttcttatctgctagctcagtcttaattatcaaccataatcataagacttatcttatggaggacgccggtagtaagtgccctctcttggcggcggatcacgtggtgtctctagagcagagaagagagcaggaggaagagtagttactacatttcccaaaatcctctttgagtcctagtcctgcctaactctcttcttcattggccaacagtactttattcaacaaccaataaggatataaacatacacagaaagacattccccatcaagtactttttggattttttgtgtgtaacaagattttattaaagtactttgtctgttagcctttgtatttccagtaaggcatcctgaatacattcattttacttgaattattttagtttttatacttttaaggtttgagaaggtaagaatgacgatgaaacagtactgtaggtaatttgctgatggctcatgcatttatatttttcttacacttggaaggtttgtttatttttcaagacatggtttctctgtgtaacagcactggctgtcctggaacttgagttttagaccaggctgccctcaatctccgagagattcccatgtctctgcctcctgagtgctggtattaaaggtgggtgccaccttacctggttttggaacagtttttataagtaattgttataggaaaatctaaataggcgttattatagacacaaattaacttgttataagcttaaattgtaatattagagtatttattttatatattagagtattacataataacaagtcataatctatactcttgtccatcatcaagcttgattttaggtattttttttagtttttttcattttagacagtgttctattactgtgaaatgacagttgcttatagttttggatgtttagtccagtattgttatgttgagaagcatggcagcacacaggcagacatggtgctggataacaacctaagagttcttcgtctggatcttcaggcaggagagagagggagagagagatagagagagagagagagacagagagagacagagacagagagagagacagagacacagacagagagactgagactggcttgggtttttgaaactgaaagcccacccctgactgacatatttcctccaataaggccacacctactctaataatgccacatgtcctaaacctttcaaatagtgccacccctaagcattcaaatatatgagcttatggggccattcttattcaaaccaacacagttcataaacttagcaggcctataaggactatagagtttttctcccaattatcacattggaactattgttagagaatttgccatttcccattaatttattcatgtatattcattccaaaaatactttaccccattaacatccaagtcttactactctctattgtaggatttcactttccagaaataactgtaaaactttcttcagtattatgaacctactactactcagcctgtcatgaaacatttatttttgctatttctctaagtatgtatgccattgaggcttgtttaattgcaattaagaatatagcattttcttggttctttattttgaaagctcttctgctttgtgatgtttaataggataagtcattcacacatatgatacttcacatattctagatttaaatgtttagtgcttacttttgacaacttagtaaagatttctgttctagctccatagatttatttttgaagttgaaaaattgtgcttttaaaatgattatgagaaacttcagcttgcatagtggtatacaagaatgaatacgttacttgtgtcaccttatgtgatatatgaaaataataggcgaaacagtattgataaaattctgtttagccctatgctcttactcattttaatccacagctaagactttccactggtaatagatactttctcttcatcacaaattggagattctaataacattgcacaaaggataggtatagaaaccacaaccaacaacaaaaaacccaaatagcctcattcatcttttaaccagttaaaggaaatgaggtaaaatgtacaaaatgcataaaaacacacaaaaacccctcaaaccttatttgccttgtctagccaagcttgttgtgttatggattttatgtggcaaacttgaaatggaatgtttttagttaaaaaaacaaaaagatgaaagtctgaaacaaccaactggcaggcttagaatacaatcatgtttttagcctacctaggtaaaaaggaggtatgaagtgactacttaatagcagcttttgtttctttaaatctgggtttcttaactctgaaattatgaacctcatttatgttttagtctgtattttaaatttcttccatgtgtttttattagtctttctcgccactgtttaagatagctttctcagataattagaatttttattttttcctcagcttttctctgaaatgctggtagagcatgacttattttctcatttaatcagttagtgaaactataatgtaattaaactcatgatggaacatgttttatccaaatttgaactgatagctaaggctctaactttggctttaaaacctcaaaatatttccattttaatattcttcaaattaggcttgtgtcatgttttgtaacatatgacaacaagggctatgtggctttctctgctataaataaatatgttgcatattgaaacagaataaattttcgtatattcatttaccaagtatgtattttattgaatattggatgaacagactgctcaaaataagaatggttagtctttgttctcaggatgatagggagtcagatataaaccaatattcattttaattatcctaagtgcttaaaggagacatccaggagattatagagaactcatttgggaggacagggaaggcttccctgaggaagtgatatttaagctgaatctttaatgatgagtaaagattagacaagtaaagaaagtacaaaaattttttcagtgtgggcaaattagagcttaatgttttaaaaatatatgtgaagaatctgagaagggagataaaaatcagagctaaggatttaaattgttcaaacattacaagctttagaacaccatggaaatacttgaaatacgacaattttagaacatgtctacaaattaaccttaatctagatttttttaaatggtttggaaataacacacagatgcagactgtctgcaactggtatgttgggaaagaaacacaacaagcaaatgggcagactgatgaaaaacaaatatagaacaaaagcaaatccattaacatatttttgtgtggatggtagggaagaagagttcaaatagggaaagatatttggaatcattttgcctatttcaaaaagtcctttcatgagatacctactcccacttgtcctttaataagccactagcagagactcagtgtctaatatgttgatcccactcattcagaattcagtgtttctttcataatattcacctaatatgcaccaaagtacaatgtgtgtttcagaacatttaaaaatagaattcaagatgtttccttttactctagtgcttatttaactatgatgacatgtctttaaagtttatggtagtgtttaagtagtagagtcttcactagttggatttatatacttcagaataattaattatttattcttcttaatgttaagtgaaagacaagaacgtgttaagatgcagagaggggaatgcataataagctttctgcttttccaaaactgcctgtagctgctactcattctttctgctagtatgcatctctctggtgtgcagcattggggcaatagccatgagaaacaaaaacaagagtctttgtatttgaattttcaatatttccagtgaaatgaaaggtatgcgcattgtcacgagacaatgaactggaagctgcacatatccttttgaattcaggattgttttggtttggttttgtttttaaattaaggcgagattgaagagacttgccttgctatttcatttcggatgcattgtacatgagtataatgcgaatgctctttgagagcatatgctatagaacttgttgaaacttctgcaagttcttttacatcatttacagctgtaaattatttcatgcttacagcaaggaggtgaacactccagaataataatcagctacctatttacaagaatgttgagaagctccaagtactgcttgcacaaaataatagactagtttcattgtagtagtgaaagttccaaagcaatttctagacatattatctattgagacagttaaaatacatttatatttcatttctaaaatatttcccactatgtatgtaagatgtctcaggaaaattttaatgtatttcattgataccaaaaatactaatcttaaatacacacacacacacacacacacacacacacacacacacacacacacacacacacaatctaccgagtacatgtagctcatatgtgcatgtgttcaaggatgaccacttgggattggacaaactatgtagggactagtgcctggcagagacacctatagctattgagatttattaccaaaatgaaacatacaactgcagtgtcactgatacttcaatttctgtttccgtatgaaggttaattctaacaaccaagaaaaaaaaaaaaacatttcagcaggaatagaagctcaattttttttctaatttttttcagctgaaggtgataattctgaaagttaggaggataaaatcaatagacagctgtatacctacatgttcattaatgaaatgagaaggtaccgatggcatttctttccaacagtaatgtgttgcagaacagtgaaaagagcacattaataatgttagcaagatacaaattgatcagaggaaataagtagagatttataaatctatatgaatttcatgcattatgaaagctgaagaaatacactgatgaacagagtacaattttagaagagatgagatagactatagatatttacaatttctctaaatttttccannnnnnnnnnnnnntatttcaattattgaatttaacaaaattttcttatatatgaaaagttataacatacaagaatatggaatgccattgagagaaccaaggttaacatttttaatgaagaaataataaaatgctaataaaataatacatgaaaactaatacacaaatatatacacatatactaaagagtgtatacattcatgtaaaaatgaaagtaaaaagtctagtagattaattttaaatatataattacagcataaactatgctttttgttaaggacataaaataatgcaaaatagataagcattgcaatcctccctctttgtctgatgattttacatggtaaaatatttccaaaatttagcatctcttctctcagtggttaggattaaagggtttgaaatctttattgtttgaagaagtcaacagattgtacctgattttaattgaaaaacatgtcttcttttccttccttccttccttccttccttccttccttccttcctttctttctttcatttctttctatctttctttctttttcccaccattctttttttcttttctatattttgctgtactatcttgtgtcttatgttgttactcattttattctttcacttgttacctgttttattttcaccttatacccacacatgtatgtaagtttctggaattctgtgtatcctcaagtataaaaatttggcttttttgttgtttgcttgttttgttttcttttgaaactgagtctccctgtttaaccctggctgaacttgaactcactgtgtagaccgggctgtcctgaagccaacaaagatcgcttgcctctccctcccaagtaacataaataaatgtgtacaacactatgcccttctatgtatcaactattttaatctacacaattaattcttatgtaacttatattgaaggcagttagtacaaaatgtagacttttttacatgtggaatctctctctctctctctctctctctctctctctctctctctctctctctctgtgtgtgtgtgtgtgtgtgtaggtatatttctctgtgataatttaccatattttgttactactaataacaataaatgtgctatttttccaaactaaaaagttgctgtgtaagttctgaacctttgtgtttttgacagctaactcactcctttcaagaataagtgagcttcaagtgccttttaggataatgaaaagtaccaaagatatcagagttaaaagtctaatggataggacactggattagaaattgaatgccccaggttccattctcagcttcctatgtttctgtgtattattgcaaaatctgattaaagaatttgttaaatatgtaaaatggggctaatacatcttatattactggaaagctactgggaataatgagaatttttaaagataatacatttttgttttttaagacagttcttatataagggacatgatctaaattctatctgaaatttgaatgttagcaaatattataatgccataacttttattccatagtttaataataacccgatacatttgttgccttttttgtgcaaatacatcaaagacctatatttaagttatgaactattagcttctgttttagtcctcttactttacaagtattcaatttcttacatattatattatattttgagaaggaccagcaggtatttaaaaaattaactatgtgttaccatggcatttaaaaataatactaaagtgtttgcctttatgatttgctctatttccattggaaaataggggcagtggagcaatggcaaaaataaattaaccttattacttgaattaattgtaaaaaaaaaacttcacaaaatatcggcaagttctcacttttttatctatgatgattaactttattgggaaaatgtcattctcaacaggggtgatagtttgtgtttgttatcccagcgcttgaggaactgagaaaggaagatttgtgagttgtaggtcagcatggtatatagaaggagccctggtatcaaaataccaaagccaaggtaatgaacaaatatacaaatgacgggcaaataatgttcttagcctcttgaaaattatgatgtgtgtccttcttatcttcatttacccagcatttagctcatagatgatccttaggaatatttatttggcaaataacttcactcgctgagataaaaaaataaaagcaatacataagtgctatttgctgccatgaaaatgaatgtgtcataagagttgagagcttctttgaaatcattataaatgaatcatctcttatatgtacaaggtattttcataaggattcaggacatttactgttgtttactcctcaaattttggcatagaagccgtattttagtccgtattcagtacattagattggttctcttttgtggaccaagacttgtgctttgcataaattacacaagtagtaattttctggagaaagaatagtatttcaccttttataatttgctttaatctcacatactgtccctttgttttttgttaaattatgtcaatttttaacattttatgaaatagtgtttccagtgaatggtttgcaatgttttagattagttgaaaaaacttgttggcatatttagcagtaatgatgcatagcattttgtttgaattgctacaaattagctggaagatgtgcatctgtaaatttagtaattttaaaatacatctcaaaaatggatctccttattgaaatctttatgtttcagtaaatgagcattctaatgggaacaatagtctaccccggagaagagcacaccaattgattgtccaataccaaatagtcatacctgaaaacatgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacacacacagtttaagggaaagatgccatgaatttgaaagaaggctggttagaaagaaggctggttagaaatgtcaggatagtgcattaacctactgtgcttcagatgttctactattttttcttgtcttgttatatttaaagtatatggtaatggcagcagaacagtttaactgatgtcagatttgggcagtatatatttttttacattttctatagtgtaaacatccacttaaaatataagatgcatagcaaatatttgataagtttgaacttctatcactttctgaagtaatttataaagagtttatatgtataaattattgaagatacttaacttccatatctttacatagtagaaaaagtcttttaagaatgtatatgcatttgttgtgttttagattaccttaattttgtctttgaaaaagacacactaaggcataattaatagaatgtgacctatgaaatattagttctattattattttgaggaaatgagactgtgttgtcttatgttcagatccacagtagacatgtttagatgtaacaatgctaaaagcagaaagacatggttggtaatctataaaactaattccattatattggcaatgctacactgctgtttatgttgacatatttgtcttactctaacatctataccatttatgggtgagaacattataaaaactacaaagcttttatgcttaattactagttcagtattcttactaggtcattctttcaagtcaggttgagatttgaggcaagcaggtttttgtgatactcattgagtactagttgagaagtttaattggttctcatgcaatagggatgaattatttatctcagaagcttgaagaacttctaaattccttacttctctagggaataaatacaaatgtttgaatgtgttaagtaaattcagtttactgaaatgaagcctaaagacccattttctacatattcttaaaatttacatatgctaacctaaataagtctgcttcttttaaacactagtgagaacattatgccactattaatgcccatttatttaatttaacctgggcatttagggaccagttgattgtattctgagttagtcccacattttacagtgtagtaatgttttgagagatcagctcacatacagagaaaactgagtagtcagttgcacccagggaaatgaaagtgccctcctctacacatgtattcactattgcctactcatgaaataccttttgctctgtctttacccccgttgtttctcaatgtatgtcctacttacagattcttgctttcagatttattcatttatttaatttagacaaaagggttctttttattggatatatttgtgtgtttgcctgcatttatgtatgtgcactacatgaatgcctggttcccatggaaggcagaggaaggcattggatcccttggaactagagttagaactgttatgtgacttccaagaactgaagccaggtctctgaaatgacagcaaatgctcttaaacccatgaacgaactatctatctgtctgtctgtctgtctgtctgtctgtctgtctatctatctatctatctatctatctatctatctatctatctagttttgaggcacaatctcattatgtaaacctaggtggccttgacatgactatgtagaccactgtaacttcaaattcatagagatctgtctgcctctgcctcctgagtgcaggtatcaaaggaatgtgtctccatgcttgtcctcaagttcatttgtttttttttacatcagcatataaaaatgttgtgtattcatagtgtacattatgatgtcctgcaacacatgtgattaaatgtagctaatttacaaatgcattaactcacagttattgtagtaaaaacacagatctcctagaatttctcaaagatatattctaaactgtagttgaccatgtcctacagtagatttcttgaacctactccccctgtctctctgtagacatgtattatatttaattaatatctctccaatccctcactcccaagtaccttagcctgtggtaactcacatcctactctcaatctctatcaaatagctttatattatatacgtaaaggagatcatgcaaattttgtctctctgtgcatgcataatcattttctcttccacattactgcaatttatagaatttcctcctttcatatctcaatgtaacattctattgtgtgtatgaaaattttaaagaatttgatccataatgaatagtttgcctctttaacctggttataaagtgaataatgctgtagtaagtatatgagtacagatatatcattggcatatggatagccattggagatatggactgctgaatcatatgacagtcctatttttacttttttgtgctcttccatactaattttcataattgatgtacaattatattctgaccacagtgtacattggtccctttctttacacttttaacacttaatatttttgataatctctgtgcatacagtgccatataggatgaccccagtggtgccacctgtgtttcctgtgtcatctgcagttaaattttaatgagtacaggcaacatgtggtgatgtcatttgttgtttattttggtacaaatactttttcatactaaggttatttcatcaggattcaataatgaatatttcactttcctggaaaagtattttctttgatacagatataaaaacagagattaggtggctggatttggttagaaggtggttagccaagtaattcagttaatgcttaatgctgtcatcttaagaaaaggaactttggagttttaaaattaccttacccacagcaggaaccattaaaatatgttcaagaattctagtttgagagttattagcccagagttccagtttcattgatgtactagcaaatctccaaacatgctgtgtttgagtttttgtatctctgtgattaacttctgaccaaaatagcttagtctgccttacatgaatagcatttattagtctttgaacttcatccctcaaatagattcattgattctttaaggtctcatcctctaccacatactatgataatctttctgctcattacatagcagaatgtgagctctgttatgacatcattgtgtctcagcttcttactgtttgccatacctgagaatatactccatgcaagtggtaatattctaatataagaaggactgactcccaatgccccatagcagatactttatgttcatgttgttgtttaatgaacacattggaaacctgcgtttaatgcaccagtagagagtaaggtaatcaactcaacttatttcacaaaaaaaaaacaaaattcctgttctaatttacatgctatgaatcacacattcaaattagctgggcctttgagattgtgtggcccagtgtgcttaaaactttattttatttagcatgagacttgctttgctggtagaaatcttcagcagaatataaatatgtaaatgatctcattattaggggaacaaaagacagactttcccagttagccctctctttttcacattccctcctcagccagtcaaggattcctgtggattctcaaaatatacttctaatctcttacctgtgatacaggtccattcctgaatatttcaggaagattagaatcctgcctctacttcaaccatatagttgatcagaagctgataatatttatgccaatgataatgtttcataagttaactgtttgggcattcatgaaaccatgaaattaacgacaaaataacatgtcatgtaagtatatactaattcaatgattactgtatataagtgtcctggttagttttttattgtcgacttgaaacaaccatagtcagctggggagagggaaagccagttgaagatttgcctggatcagattcatgtttgaccaaacctgtgagagtttgtcttgatagattgatgttggggaggtaacacaatcaccactcaggtgggtctgtgctatacaagaatgctagctgagcataactagagaaaaaggcagataacagtgatcctctgtggtttctgggtaaagatcctgccttgatttcctgcccttgcttccctctatgatggagcatgatcagactgtcataagctaaaaataaatcttttcattccaaagttgcgtttggttaggttggttgttctatcacagcaacagaaaagccaactggaacaaccagataattcttctttaccaagattattatattactctaacaagcctacagatagacaccataatatttttgttttgtagaacaggaacctaaggtccaggattaaaatgacaaacggaccagtttcacatggctaataagggtaaagtatagtgaggaaatgtttgttcccttccctttggtatagtacatcattgtaaataatttagcccccccccaagattgtcagatgcatttttaagcaatattttgcctagttgctaggctcaaatgaagtggtgtatttctataggaaggttagtgaaagctctttgtgctataagcatgtaaggtaccattgatgactaagtccttcaatctcaattagtatgaaaggcatgcatatgtttatttttcatgacaatcaatcagttctttcagttctcatttactcatcctttacacgctttgttgatactttacttcctgtcagcagttacacaaggaactgagtagtattcagtgcaatcattttgacagcacttactcaaatgcttggaaagttacaggttggaaataatgggatcacttcttgtctcatggaagacatttttctttatttcctttccaatttatagcttcattacctacttaaaatgtaatttttatgtaggctgcaggaaacatttataatcaacaacaacatttattaaacttgttttgttacattgtttgaagttaatattgtagttggagatgtaaaatgataaaacatatagggaaaatattaaacttctatttcttaataggatcgcctctatataataaattttggtaaagctttcacatccctatcaaagtctatcatgaagggagatgacggcaggaacctgtgggaaggaactgaagcagagagcatagagggattccaatttactggcttactccccatggctgctctacttgctttctagtaccatctgttcaggagatgtactacttcaagtcaactaggtcctaccacatcaatcaagaaaatgaccacagacatgcctacaggacagtctgatagaagggtcccttacatgaggttctctcttctcaggtgactacagattatatcatgttgaaaaaatttagccaatacaagcaatagcagtattgccatttttcaggataatattgccctctctaaaggtggacccacggacagtaattgctatctgtgtgcaaaccatggctgaaagagctatgtacaatcaatggttccagccagtgttcacagcatgttatgtttccaactaagaattctgtaggcttttctcaaattaaaagtcaattcgtttttacattaaaaactaaataaaaggtatgggatggatagtgcattagttggcagggcaggcgaggaggggagggagagggacctgggattgacatgtaaaataattttctttctaataataaaaaaaaagattggtccaagtaactaaacttattagtttgtcattttcactgcagacttagaacattctttttaaaatatttcttgtctagtattgatattaaaagtttattttagagtaaagggggatgttaccaaaagtacattttagttttctgtgtactgacttaggataatataagcatagtcatacggacaagtttctacattctaatgattttcaaattaaggaatggcttcaaattaggaaacctttttattcacctagctttggaatagcatgttgtactctaattactaactttgtctgcattactttttaaagatcaaatgggcacagtggtaattttcattaatctcatacagagcagctaattaaaatttcaattattatccatctattatctagttgttgcctttgttcagtatcagatccggatgttaataataagccgttcttgtattacagctctattaagtacagtgagatttagtttaatctatcacactgttttgtttcagggttatttctttaatactatgttgtgccatattgattatgctgaagatacacactttgacatttttcaaatagaaatttcagacttatattcctgttgcttcaattttttattcaacattggggaaagtggcatagaacggataaatgaatcattggaagttcaaaatatttataatttagttctgaaacctcactaattatgccgttacctattccccagaatctacctgttttaatgtgtagtcttggctgtcttagaacttactatgtaaaccaggctggccttgaactcagagatccacatgcctctgcttcccaagggctggtatgggaggtgcatcacaatactccgctgacttctttattcctataatgagaatgttaaaagatttgattttgggaggcagaggtaggcagatctctgtgagttcaaggccagcctagtctcctgagcaagtgccagtataggctccaaagctatacagagaaaccctgtctcaaaaaaccaaaaaaatattattttctgtggtacatataactgaatataaatgttaactgtcaactacaaaattaataagatgatctaacaatgtttatattttgaattgagggaaacagttagcataaatcctaatacttggaatataagtttaaataaccctgtcaataatactttttgctactcacatcaggtttcttttcagtctgtgaacaccagctagtataattctcttttaaagggctgaggagaatgtatcctacacaatagtcttcccactcaggtctttgaagaattgttggtctgggaatttaacatggaggtagagtattgaaacaaaagagtgaggtggcatagcactcacacaaagtaaaatattgatataatctttattcttgtaattaaaattcctttaattttttaaattggtattcaaagcattagattttaatgttgcttaggagaaaagattattgaaacatactttgtttgaaaaatgtcataatgttattaatatagtctatgttttacttgcaagatttaaaaaaaaaacccttgacacctctttaaaatgacatgttctatttgtttgatagggtggcctgaaaaacagcaagcatgaatgcaccctgtcttcacaagaatatgttcatgaattgaaatcaggtatctcagatgagaaacttctcaactgtctggaatctctgagggtttccttaaccagcaatcctgtcaggtaggcagttcttatcatttttataggattcatacattttgtattgtatatagatatttcgtataatcagatatgttactttaacctcatgatttttctgttcagaagtgtattatcatctaatagaagagcattgtctgattatcaagttctaaatgtttaaaaacatctgtttagctattttgatctttactcatgtatgattttaaaatataggtaattgtttaatagttatttcctttttgagaaggagttaaatctagaagctaaatatttacatttgcatattagtctatttgtttaccaagaaaattgttatatatttgcgaaacacattaattacattggtttaaaattttattccttttacacttgtgattatacgtatgtatataatttcatattatatttaaattttacatagaccacgttacacacaaacatacacacacatttttgtaactttgagatagctcaaactacttttaaacaaataaagaaatggagactattaattaattccttactattttatacattcattaaactatcttacagatgtttataaagaggcaagtttttgatagcaatgggtttgaataataattctttattgacaataacaggctttaaaattagtaatatcccaaataatgtcttatgaaaaaaatagatttcaatgtaatattgaatcattctgtgatctacatgctaaattatcaccgttttgagttcagaatttactaaaatgagtatataaagacaatgtaattttattagtgtttcccttatatttttcagactgatatctagttcataaagcactgaaaataatttaaatctcagtcatttaggtggaatcaggtataaattcgatatatttgttatttagagtcatatttttgataaaatttgaaagttataatttcataataaagacagtgttaagatgtgacttgctttaggttagaagcattttttagttgttgctatcttgctatttctaaaatggcatgcttttaagatttagtgatctcacgaaaagatttgagatctctattatttttttattttgtaccatctcaaatttgtaggccaggccagcctggaactaacaacatctttcaggctgtgtttgaatgttaagtaacccttctgctgtggcctcctaactgctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgcaaaggagggctttgtaatctcgcgagaatgttgggtcctcatctggtagctgattggctgttcagtaaggtcttgaggcgttggcattctgcaatagctctagtccgaggttggaggtgccatcttgctgagattcgagagaccgtcgacaagcgagtttctgtgcagcctgtgagcgaacacctcttgctgtcgagccatcaaatcctgccaagacttcaaaagatgatgagtaagagtgggtttgggagtaatgatagctttgttgatgatgatggggctaacagggcaagcggcagtgatgagcaagctggaggtcaggacctgggtcttcccatgaccaccttgaccaggcctggcattcacagcattgtgccttgctgcataagccagttgcttactgctgttgaggttgacaacgtgtttaagatcaggggctttgcacttcaccgggtctctatcgtggggatgatcatggaggccaagaaagcttcgcggtacatgatgtacaagattgatgacatgaccgcaaaggccatcgaggccaggcagcccctgtcgcgcgagagggtcaggcaatgtgtgattcccctgccagttggcgtgtatgccaaagtgcttggtgtcctccagtcctcggagggaaccagacggcttggggttctaagcatccgtgtcctggaagatatgaatgagctgtccacacacaccttggaggtcgtcaatgcccacatgatgctggatcaaagtcgtgaaggtgtgtccacaggaaggcacctcttggaagaagccccagcaggagcagccgccgccagggttgctaaggcagctagtcttaatttcatccatttggaggtgctgcgtctgattcaagaatgtcctcaccaggaagggaaggctattagtgagctgcgaagagacctccatgcacttaccgatgaagctgtcactcaagctatcaggcatctgatttccacacaacgcatctctgccacctcggatagtgagtaccttaaaatttcaggctgaggcaatgaaaggattttgcggtttctgaagatgtttttgttctactgttcagacttttaggaaataccatttgtttcgaatgacaacaatgaaatacaaaaaacaaaaaacaaaacaaaaagaaataaaacaacaacaaaaaaactctccccaaattgcaaaagcagatgaaactgaccgaagttctcagcgccacctgttagcaatgtgctatttctaactccattgaacttgttggttttctgaagagatttgaagtgttagacccaataactggactcagtacagtttctttccaaaattattcccttggatggaattataatggaaaaaatgtgtccaaattagaattatattccctgtgttaattaatcttagctatgctaatttttcctaaatatattacaagaaatacagctttactggaaattgttatgatttcaaatattaggtcaattgtttgagtaatttgatttgattaacattgatttatttacttaaaacacaatatttgactacttatttaatcaattcactctttttttgagtcatcttcaaataattacttttaacatgtgatttcagtggttttgctttttctattaaattagtttacttttcttgtattgtatgtgggtgccagactatgtttttctcatggtggtgcaataccaacactgctgcgatggtctactctagggtaaaacaggttgttttgtttagagataagctttataacagttctagaaacagaagacttaatgagttgtaacagaaattaactaaattgttccattaaagctttgcaaagaaattttaagtttcctgtgtgatttttccccaaatttattagaaaatgttgtaagtttaatgtttttaagtgttataagcttctattatgaagtataaatttttgttttatttttaataccaatcattatatcttactagtactaactcatttttgagttggttatattaaatatgagaggcctttaagtcactgatcattaagccctccattatgcatacaataaaatggtgtatttcaaattacttgtttggttaaattacaggaaagaacaatatttttctagtaatagatgggtttgcctatgtgtgttcagataggtagaaaagaatattgatcctcttcattcattaaaaggtgacaaaaacctataacatagttttgctatttagcagtcagtaatctgttttcaggaaaatagtcagaaagtgatggcctttcatgatcagtccttaaaataattactgaaaaatcttgcagaagatcttgtgattcagtgtttactctcctcagaagcacataaaatataaatgctatttaaaatttttatttttttaacgttttaaaagatatttattttattcacgtgagtgttttacctggatgggtgtttgtgtatctcgtgcatgcctggtgcccttggagatcagaagagggcatcatatatcctgactggagtggcagatgtttgtgaaccactgtgtgggtgctggaaactgaacttggactctctgcaagaacagtgttcttaactgctgcaacatctctccagatcctataagtggtattttttaaataatattttgttctttgataaatctagctaattaattttagtcatacatgaaagaaccctgaaattgtcacaagacaccccaagaccaagttctcaggacaaaagagattaatttgactcagagggataaaaaaacagcaaagtagagggaatgtggagaagagtaaaaggcaaaacctgttggtgacatttaaacattctgtgccttcaagagcccttcaatattcctcccctatctctttctagatactcccgaaattaaaggaaataaaaaggaaaggacatggctgctcctaggtatggtggaggagaaagttcattgtagagatgtaggagaggataggcagaggcagggatggctgggaaagtccagagtggacaagaaccagactgggctgggctacttgggggaaggggtgtgggggcagaaaccatgtgcagcagccatgaggccaaaggtataaaggactggtaatcaaaatgtcttgattatgcagggcagagcctctgggggaaggacagtctgttccctaggctggaaagtttagggaaggggatggacatgccagccataacctggtaggaactgagggatactgggagagcctggtggccaggttggcttctatatgtaaataggtacctcagtcatttgttccagttttgaaacgtaacacccctaccttttgttgatactaaagggggccataatcatttgtgcctagttcctgttgacactggggcattgttgttgaggacccaaaaagctggaatgctggccaagtctgggaagctgtttcacttctctggactctgggggacttctggggttaggaaagtgcaagcatcatttagagcactttgccatctttggttggaaatcttctggaacagatatattaggggcagaaggtagagttaagtttagagggaatttttttccttaggtgtacaattgatatttcttggcccatggtcctcttagctgggggaggggaatcccaaggacaggggaaggggaagagatctcacccacagaaataggcaggtggggaaacagaactccattgattaatgttaaaattctgaattcctgaaacttaatattgcagtagcatagcaagggaaagaaatctaaagcatttttcactttttaagtatttaaatcaccttaaaaaaatttttttttctgagtctggtaacaaggtaaactgtgcctagacctagtagtagctctaggggagtaaggcctgaagcttgatttttacacatgaagagaactgaaaaggcagatgaagccttggttgctgctgttaaactcacaaggctgatactagcattgtcattaacactatttgagatctgagaaggaagaatttcacctaataggaagtacagaccaagcagcttctgaatctattaaaaatgacagagactagtccattacccagatggccatcccaggctcctgtgtgtaatgataaatctttttgctaacccgcccgagtcctgctgccatgtgggtagccaaaataacacacagactagtattaggtacaatgctgctggccaatgcctaagatttctcatatgctaactcagtattaattatcaaccataactactaatctttatattttataaggcttatggaggatgccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgggatgggctctcaaagtcccttcttataccagggaaaaatactaatccactaccaggggccccctagagtgcagaggccacctgattgacatccgtgttcaggggtctggatcagttctgtactgtcctcccatacagcagtctggggtccatgtgctcccctttgttcaggccagctgattctttgggtttcaccagcctggtaccgaccccttcaattttcattcctccctctctgcaactaagttccagcgtacagttcagtgaatatctttggatgtctgcctctgcttccatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcatccttgtaagtctctggaaatctccctagtgccagatctctccttggacctataatggctccctgtaacatggtatctctcatcctgctctcctctattcttcccccaactcaatatttctgctcctcgatttcctcctctcctctcttcttctcctcctctcattctggcagctctgtctcctctaccctcatgctctcaattagctcaggagatcctgccccttcccattctctggggtccatgcgtttttcccttagagtccttcatgtttcctagtttctttggtgaagagattgtaggctggtaatcctttgctctatgtctaaaattcatatgtgagtgagtatgttacgataaatctttccgccaaaagtcgcctgagccccactgccatgtgtgagctttacgccagctgccctcccgagttaggcccaaatgaatacacagaaacttgtattaggttcaatgctgcttggccaatgactaggattgttatctgttagttcagtcttaactatcataaacctatatattttataaaacttatcttatcggacgcctaattggcatccctccttgtcagtggatcacatcatgccactggaacaggagcggaggggaaaagagagcccttcctgtttctccttcgcttaaatatgagtctccttgccatgtcacttcctgcctgtatcagcacttctctactacatttcccagaatcctctttgactcctagtcctgcctaacttgtcatttcattggccaaacagtattttatttaacaatcaataagataaacatacnnnnnnnnnntccccatcatgagtacataccatgtttgtctttttgtgactgggttacctcactcagaatggtttcttctagttccatccatttgcctgccaatttaaagatcccattgcttttttctgctgagtagttctccattgtataaatgtatcacattttctctatccattcttcagttgaggggcttccaggttctggctattacaaaaaatgctgctatgaacatggttgaatgtatgtgcttgttgtatggacatgcattatttgggtaaatgcccaagagaagaatttctggatctcgaggtagactgattcacatttttctgagcaactgccatactgatttccaaagtggtcttcttgtacttccattggcatgtctttctttaggttggtaaagttttcttctataattttgttgaatatgttttctgtacctttgagctgtatttcttcaccttcttctatacctattattcttaggtttggtcttttcacagtgtcgcgtatttcctggatattttgtgttagggatttgttggacttgaggttttctttgattgatgaatgtatatcctctagcgagtcttcacctttctatttccaggatccccttgttctgtgttttctttattgtgtctatttcagctttcatgccttgaactcttttgactgcttccttcatttgtttggttgttttttcttggctttctttagattctttaagagatttatttacttcttgaattttttggtttggcttttccttcatttcatgtaatttttgcttgtttttttttttctatttctttaagggattttctcgtttactctttatagatctctatcatcttcctaagataatttttgatgtccatctcttcctcatcctctgtggtgggtttttcagatctagctggtgtggagtccctagattctggtggtgtcatattggtttttctgtttttgagtgtgtttttactctgtcttttttctatcccttcttccagtgagtgcaggtggggtctctctctctcaggtggttggcagaaggctcagcctctggcagtcagcgggatggctgagggtggtgggtggtgtggacaacggtggggtgtgtcaggactcagcctgggccttcccggtcaggtcaggtccactcttctatgagtggactcaggcagaaggaagcagggattgatgggggaggttggggagcagagcagcgcccagactcacctgagatttgggcacctgcagcaggacagagggcaaagtgtagacaggggtgaggtgtgtccagactctgggtgggccttgctgtttgggaaggtcctctcttgtctggggtagggttcaggcagaagtgagcaggagtttatgggggaggttgctgggggcagaacagtgcccagactcacctgaggctccagtgcctgcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtgcctgctgcaggacagagcagagtgtcttagggtttctattgctgtgaagagatatcatgaccacgaaaacccttataaaggaaaacatttagttggggtgaattactgttcagaggtttagtccattatcatcatggcaggacatggtggcatgcaggcagacatagtgctggataaggggatgaaatccctacatcttgatacataggcaactgggagtgatctgaattaggagtagcttataaataggagatctcaatgccctctcccaacacccatactccaagaaggtcacagctactcaaataaaaccatacctcctaagaagctcactccctgtgaggttatgggagccaattacatccaaactaccacatctaagaatagcaagaatgttgagaagacaggtccttagccattctaaggtagtaacagaacccagttaggtttcacaagcctctcttaactcagttacaacaaatttatgacaatcatcctaaacttcaaatattgacattgactcttcaattatcaaattatttgtgttaactacatgatctttgtattgcccagttcagatttctaatagagcatctctggtagatggaaacaaatatattccaggtgatgtctgagaaatgtagctggaacctttatgttttaactctcccatattggagaactcagtataaagatttttatggccatagtgagttataagtgagatagtagttgaaaaattcacaccttggaattctttgtcttcagatagatactatgtccatttcttgatcttcatcagttctgtatctgacatcctagggcagcatctgcatttctcttaagtaaataaactcccatgaagaaatggaaaggatgacacttaacatagaatgccatttgaaatgaatgaattattaaaagattaaggaaaggacggtgtcaaaagtaaatccaagtctatatcaaagattggaagggaggcagaaacaaaagtctcctatttatcaccacatatttcaattttccttcctaaaattgtgaataattttgtcacggatgtattttatgtttcatatcacagtcgaaatatagttcctgatggcactcttacgttagtggtatttgtgtttttatcacaagactaaataagttctgaaggtacaggataatgtcttcctccatttagaacccacagtaaatagtatcattgatttttaaataaagtgtgtagaagtgctgtaggaaatagttatttaatgttactaacactttgtacattaaagaagattcattttattcctttgaagtgtcagcatccaccccatagtatacaatggaatatacttcctatttccaccaggtaaaacccactgtaaaccatggaactttgctctctagatattttcagctttaaaagccctctcagaaagtaacaaataagcaaacaaaccaacacagcaaacaacagattaatcttcctactggatagaaacaaatatgtaaataaaatcaatgaagcaacagcaaaaaggaagccagcattagaagaaaccaagaatcataataaagtatatgaattaagttacacagataaaacaaacactacaagcaaagacaaatcactttgagtacagtgtattgtgcaacagttaaatagtccttgaaattagggatcactgagaatcatcctgttaatctcatatgatttgtgcaacaatcaccacaaagacagtagtttaaaacattaaaaatttagactcttaaagttaaagaagacagaagtttcactgagcttcctcccagagcttagaggaagcatttttgcctattctggctccttggtttccctggctcttggcaggttgagtccagcctttgctttttctttccatggattatttattcttggaccacttgtctgtcttttataaggacatgacttatggcccactctgatccactagaaatgtcattgtgatctttattttatatctagaaacatcctattttcaagtaaagtcatattctgaagttctgagtggataatgttcaatccaccattattttgcaaagggacattagctttaaatcaattaaaatgacaaaacaaggctcagttattttcaagaaatggcattaactagctcagaaaagttagaaaatataaaatttgtcactttagcctccttagtgaaattgtattttgctagattttttcttcttataaaaaagtattttttgtggttaccaattatgagggctatatcttatatgatggagttactctggagtatgcctgagatttggtttctgttccttatgctctcactttcctttctaagttggtgtacttgctttgcacctcagatactccttattgaaagcttccagtataaacctatgagttttatgttctcctttgcttatttccattcttattatcttggcgcatagaattagcttcctggctagaaattattttcacaaaggtgggtgactgtttctctacaaatttagagaatttttaaaagttaaatatttattatgtttgattaacacagatgaattttaaagatttgttttttatgtatatgaatgtttgattacatgtatatatgtgtgcagtgtgtgtctgttgaaagtagaggccaaaggatacatcagatctccttgaactagaattacatatgattgggagctgttgtgtaggcgctgggaactaaacttgggtcctcttcaaaaagagcaagtgttaactgctgaaccatctctccagctccagacatttttgtttttttgagacaaggtttcattgttttgccctgcctggcctggagcttactatgtacatgaggtgggcctcaaactcacagaggaaagcatgtgccaccatgcctgacacccattccccagaatttttcttgaaatgttgaagtacattttaatactattgttgcataattgtgtattgtacatgaaatccaaaagaaaccnnnnnnnnnnntgactccccattcttaccatgattataaatgctttctttgtgttcaggaactagttttaaaaaatcaccattaagttttattatatattcttttttcccattaagcaaagattatatattttttgttttgttttgtaagttttattagttcaaattaggaacaagcttgcttcacatgtcaatcccttgacaggggctccctaaattccaccacatcatcctgagccgggcctaggccttccccatgtatccaggctaagatgtggaaagggctctcaaagtcccttcttacaacagggaaaattactaatccactaccaggggccccctagagtgcggaggctcaggggtctggatcagtcgtgtgatggcctcccagacagcagtctggggtcaatgtgctcccccttgtacaggccagcggtttctgtgggtttcaccagcctgctactgacccctttgatcttcattcctccctttctgcaactaagttccagagttcagttcagtgtatatctgtgggtgtctgcctctgctttcatcagccactggatgagggctctaggatggcataaaaagtagtcatcagcctctttataggggaagggcatttaggttgtcctctccaccactgccagattgtcagtttttgtcatccttgtaggtctctggaatctcccttgtgccagatctctccttggacctataatggctccctgtaacatggtatctctcatcctgcattcctctattcttcccccaactcaatatttctgctcctccatttcctcctctcctctcctgttctcctgctctcattctgtcagctgcccctcccctaccctcatgctcccaattacctcaggagttcctgcgccttcccattcccggggtccatgcatttatcacctagagtatttcatgtttcctaatttctttgaagaggattgtaggctggtaatcctttgctctatgtgtaaaattcatatatgagtgagtacatactatgtgtttttgtgactgggttacctcactaaggatggtttcttctagttctagtctgtcagaatggctgaaataaaaaaaaacaaaaacactaatgacagtttatgctggctctgctgagtagtactccattgtataaatgtatcacattttctctatccattcttcagttgagaggcatttaggttgcttccactttctggctattacaaacaatgctgctatgaacatgttgaacttatatgtccttgttgcatggacatgcaatatttgggtatatgcccaagagaggaattgctggatcttgaggtagactgattcccattttttttttgcgcaaccgcaatcacagatatttaaaatattaaatggaataatcaattcacatttttttattatttaattcactgatgataaaataaagttaattgagttctattattttctgctaaaagcaaatgctgaaaaatttctcttatcaactataattagctcatgatgtctcaaatctcttactgtgcattccgtcattatgtatattctgttatgcatatttattagtagctgcctatgttttataattgtttcatgctcacatgtcttcttttctcatttaatttttcctctgttctggggaagtggcacacttgcagtcttgtttgtttcatgatgtctgatactgtgtaatttatgtacaaaaaagtgtgatttgatgtggatattgacccattaggaacaacctgtgcttcttaagcaggaagaaagaattctcattaatcttgtactattttgtgaccatgcatttttagctgtgatcagaataagataatgaatataacttctcccacataggattggaatgtgttggtttgattgaaccatattcataagctgcagacagcattgcatgctttacccattattctttttttatttcacagtgacttaaagaaatacaatgtttattattctaatactctaaaaatccatgtacttcagcagtaaaaggaatcttagtcccttcatcacaacttgcactagactttgcacataccatggtctctgtgatttagaaagagcagtatgtgacttacaaatttgtatttttattcccttcctgaatttataaaaggaagcactgtctaatgggaaatgacttgtgagtttggaacattttagcccagtgaagcagttataggatatatagatatttggcaatatatttcatgaggaaccaaagtgtgatgcaataaaacattgccagaaaattttctcaacactcaactaaaagagaaaatactattttgaagattagtaaagctgtaagtgttggaggatggggacttttgtaaaatattgggcatgacttggctgttgtgcacatgaactcacagtacctgtggttacctgcctaagaactgcagaagatgaagccactcaaaatttttgcagcatgggcaagtggctcaaagggcctaaccacttgctgaggatttagctgttcagaatttatggtttccaggggatggagtgtcacttttatttgacctcctgaggggtgtgacctttgcttttttttttttttttgagacatggtttctctgtggctttagaggctgtcctggaactagctgttgtagaccaggctggtctcgaactcacagagatctgcctgcctctgcctctcgagtgctgggattaaaggcgtgagccatcaatgcccggtggtgtgtgacctttgcttggttaacaattcttcagtggatggcctcacagtcacacacacatgggcagcattaactgggaacaatggaatttattgtttgaaaaagaaggcatggagtttggagtagaagggctctgtggaaaatcaaaggagggaaatgaggggtggatgtgatcaagagatgttgtatacatgtctgaaattccaaaagaataattaaatattttaaaaaatagcatcctagaattgtgattgaataggatgattttcatcattcttctggaaatatccttgtagcttgagggatatgttatcatgcttggaaacttttcttctgttttgctgagtatctgaatttctgccaaacccaaggcaaaatgattgtgctcacttcctgtgactgtggcttcctcagtaaatgttttcacacatgtgaaaatggaaaataaaattgtctcaagtttataaatgtgcagttgtttgtgttatctctgatgtattttttcttgatagttctttcatttatgtttaaacacattttctagcatattaacaaatatgcgtttaacatagtcagtgtaatgaatgtagctggatcttgacagcagtacaaattagcaatagaagtattttctcaattatgagtgttaataactatttaaacagcctgtattaaacttattaaaagcttggcaatgcagccaacactacttagagaattaatataaaggtaagtacagatcaatactcctagaatgctttattgagagctacctatgaaaaatggaataatgaaggcaatgatttatggtgtagaaatgggaacaggacttaaaaatgtaagcacagctcagaaggcagcattttgagtactattactaaagcaggtttttaatatttatgtttgcagtttgtttgctgtaagtttctagtacatgaattatttcagaatattagtagtacttttatgcagagaatagaaaatgctgcagtcattgctgttatatcaactttcatgcattctgttaaatttttggtcagtattatcaattagtctcaagcacatacaaattaatttgaccaaactaacttaaatgttaagaaaccttaaaattttaatcatgaaatatttgtttaaaatgcaattttcttgccttagttacattcagcattatacctcataatagaaggaaacaaggtctttgtgtgctatattaattttaaaaggaattaggcagccaggctgtggtggtacacgcctttaatccagcactcacggggcagaggcaggtggatttctgagtttgaggccagactgttctacaaggctagttccaagacaacatgttcttttacacaaagtaatcctgtctcaaaacaaacaaacaaacaaacaaataaaccaaaaaatcattaggcacacccaaagctgagcaagtctttgaattgttttaatgggtaactttcagtatagttatgataaataggggctctttgtttgaatttgttttatttttacatgatgtggatattccaccaaggtcacatctttttttttttaagtgatatgtgagaatataaagaataagcatctaaaatagaggagaacgtagttcatttccaaagtctggtccattgtgacataatgatctgagtgtatattatttgtactgaagagtcatgggtagcaatatattgcaagacagaattttcacctgtaaattatggtgcattcatgatttaaagggggggaatcttcctaattttgaacttgagaattttatttcatgtttttcaaatcagagatactgtacaaaccaattcaataaattttcatgaaacacagagaatctctatgaatgaatgactgttcttttcccacatggagcctttctactcacacctatagtaatagtactagttgcagatttcctgcattctaacctgttactaaggtttattatatttcaggaatgcccctgaggttctcccctgggcatatctatcatctcagctaaacttttgataggagttggatagctgacaattcacaattaagatgccagctaacacacctaggagagctaagtattccgtgtggattgttgagaggagatccatgtgcactagacaacagtagttgctcttcgaccccagctgtttgactgatgttagataatggacatttaaattggggaaatttcccacctatcagtaaggctatttcacttgaggcaacttcaacctgaaaaccttgtgttgagatggaatccatacaggcagaatgtagaaacgagcatgatattacagtgttcttttacaagtaaatgagcttcaggtgagattgtttagcagcctatgacatgaatatggttttaaagccttctttcatcccaaataaacccacagctagatgtttgatctcttctgtaaaatccagtgctgctgataatattcaggttgtctccaattccccctattttcaggaatatatcccttggttttgagtcgaaatctatgtaggtggtggtggtggtggtgatggtggtggtggtggtgtgtgggtgtgtgtgtgtgtggcatgtgttttaatattgtactgtaccttctttgatgtcaggttcctaatgagtttctttgagatgcattcttaaatttgctttttcaatattcatttatcaaaaggtactgaagactgaagtgctgtaaacagatttacaagaaattatgttatcataaatttccccatggggattaatatttatttgtcaaggaataaaggacaccctgaaatagatccaaatctatatctgtattaagcattaatgaatatttctttcatatagaaaatgtttaagaagtttgtattgtgttagagcccagcatatgaaccttgattgaaatagcataatgctattattgtgagaggccatcaatcttgggatactctttgatcttaagtcacactgtaagttgtaaagtattccttccatttacttattcatcattacattcttctgggaatggaatagaggatgtgttatgtttagtcattaggaggcttttatttagttatctgaaattattttcttaaaatctaattgatggatactatttgtatatatttataggacaggttttgacattttaatagatgtatgtaatgtgtaatgatcagatcagggtaattgaaatataaatcattccaaacacttatcaattttttgtgctatggacattaaaaattatctccattagctattatgaaatacacaattaatcgacactaattattctcttactttgctgttcaacattggaaaacattcatcatattatatgctatttgaacttattatttttgaattatttacaagtaataataattcacatgctgattctagcattcactttcatgacttctttctccttttaaatgagcctgggaattaaaaatatactattttagaagagttgagttgaggagaaagaattccaaatagattaacatttcaaatatgtgactagacgtttctgagctatcaatatgaatgatgctagataaatacgaataaccaaacacttctttagagatggaagaaacatgtttctggcatgctgtgaggacatatatataagcatgttgctgggatttttctgtttgtgagctcgcaagtcttgaaatcaaacgaaattattcaacttacttttaaaataactattcggttgttatttttttaatttatttattagttctagttagggaaccagcttgtttcacatgaaagtccctttttcctctcccttccctcacctccatccctcctcccccacccccagcctacccccaaccccacccacccaccactcctcaggcagggtagggccctcaacgggggctcagcaaagtccaccaagtcttcctatgctggtcctgggcccttctccatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagtggctccctctgatattgtatctctcatcctgctctctctcctctattcttcccccaactcaatatttcttcccctccatttcctctcctctactcttcttctcttgctcttattgtagcagctccctcccccctaccctcatgctcccaattagttcaggagttcatgccacttccattcctgggaaccatttatcccttgtttttttttaacaattgaataaatgaatatactttattgttgggagttctcttatcccatcatggttttgtatctctgccgtgtgcatatgatctggagtcacctttgacagtgtatttcatcttatttgctcttacttttgttgttttgatcactcccagagcttttctatttcattactgaacttttgttcacaccttagtccttttggaaaaggacatcattgaaagaggatgggggttggttttgcaaaacaaaaaaggaagtcattcaatttattgaaaattgggaaatttgaaatttgaaattcaaagagatgatgaagtaaggaagttagtggacagggatggcacatgacagtctgcaacattctggctgagtagagaattctgtaatgtcaaacaagcactgctattcccaaaccaaaaacaactattacattttcgctagagacttctcaatacttttctagcagactgactatcaactcatatttactacatgttttgacgttaattttaaatgtttgtatgtaattacgtctctgtgttttgatagtccatcttctgtagtattttcttctctaaagaaatatggtattaattaggaagtagaaaggaaaatagattttcagggatgttctattgttttatgaggatggtagatggaaggaacaggttctataatgagtatcctgctgaatttttcacaacctgtgtctagaatactgtgcaacaaaaagtgtatttgggggtatcagtactatttttattgcctaaagtttccctttctttcatgatggaaaacaaaatgaataatcaaaatgaaaataccttactgttttttgtttttgcaagcaaatacatccattggtgaatttaaggtataatttacatcatgaaatgaaagagaaacccagcaaagaatgctatcaacaaaattgtttggggttactactggggacggaacattatacaccgacctgtattgccagacttcattttgtaacccaggctggccttgagtttgtgatccttcagcttcagtcctcagagtgacatggaactttgatgtgttgcagtagatctggcttaactgataatttttatattacttgttgagttgttaataatgaacttgtataggaggaaggtagcaattgcaaattgctgagtataattctgagtataatttttttttctatttagcattgtggccaaagaaaatgtagtcaactttatatttttcatctgggaaatggagtaacttacttgattttatgatcagtaaagctatacatttcagtgttttattttgtaacagtttatttgcaaatgaagacaaatttattcccagtcagcctgcttccctccctttcctcctccctccctcttttgcatcttttcttccaaaaagattatactttatttggtgtttaactgtccaaaatgaggagaaaagtagctattacactttctatagtgaatgaacctataattccactactcagagagtctaagcaggactattgtgacttggagacttgccctgattacatttatgacttttaggccagcctgacaccttgttttataaaaccaaggataggcatgtagctcagtggtagactacttatcaaccatgtgcaagtctctcggtttgatctccctggtacacacaagcaaatgtcattagcattttgagaaggctaatgaaattgtagtattcataacattatagtcctttaaaagatgtttatatcttgagagacttattacataaaatgtgtatcttttataaattactatacttttcaattattctgaaaataaaaaaaaataggccaggttgtatatactaaaggatgatatctctttcatattttatcatgtaataattatatacatcatatgttagctattatttttgttaacacatattcattctacatagatggcttatttcattgtaatagaaaaataaagattacctttcacttaataattgacaatacacattaaggttcctgttttgattaatgtgttttcgttaatgattttgaaaagtttcatttacatcaaatgtattaggaaatttatatttgtcaaaggttacaaaatttctcacgttatctagtgtatatagtggtgactatatacagtaaataatagtataatatactattgaaaattgctaagaaaatatattttgtactgttttcaccataggagaaaaatgatgaggatatgagaaatgtatatgttgttattccacagctttatgaataagtcatgtgtatattataaatatatatggtttccactactgaaaatacaatgaataaaaatacatttacccatataggtacaagcaaaaattacatattcgccacagtttatttctcagttttatatagatatatttaatataaaatataaagattaatacagaaaagacaaaagtttctatctttaaatttcatgctcttagtaaacaacatccaaagaaattgttcctttccgacatatgtgtaatatcctgtgctaaaaatatccgtgaacattaaatttgtttgatctttgtctacatagcaatcaccatgtataatgagacgttaattacatgtttttcacattgtacctggtaggtgagaagaaaggttgcatttctgtttcgtactcatcaaagagcaattgtccttcagctttccttgcccttcttttcttatactgcaggagaattcatttaccacttgtttacttcccagcagaatcagaaagcataatatacaaactgggttagaaaaaaggggatgtgagccagtgttttgtgctaatgccattgtttttcctgattgcagtcaaggacttactttatttatgacagataaactctgtcaaccctttttcattttcaggatttgcagattaggaatgtgctttcttggaataaattcattttaacaaaattcaatggaaccaacagaaattggatgtcctgtggagtacatgatagaattttagctatattacttagctttggaaaataaaccaatacatttttttcttgtggaagctaacattttattgtaaatttgaatggttagatcagtaagccatcagatttagtaagttttctaacataattatagtcacaattgcaaacatatcaagatgtaaaatatgactggttttggcttgaatatgggaaatgttctttactcttgctttttctctatttactatagattgagaagtctattttcattttcattcacacttgaaataatttacgccattattgctacaggatacaactttgtattatacttttataacttttaaaggcagatgcaggggaaaataatcttcactgcctagcctgttgatatttaaaatagatacagttaaagctatttcctagactatctccaaagtaattcaggcagactaagaaattgattttaataatagggaactgttctctgagagaaaatttgcagttagttttgttctttaagaagactattgcatgcgacttgaggtattgcagtattttgttataacagtatgaaagagaaatttgtttttatataatgtaatcaacctgaaaaggtgaacattttctcctcttaaaagggtgtgaatcacataggacatagcaggatcttgtcagtgagactgatggagagaataaatgcagccagagagaacgattggatgtcttctttgggaatttctaaggaaattgtaatctatcacagcattcaagaaaagcctctgagaggcaaagctggaaaattaacacattcaacctttttgtgaatcaggagaaataagcggtcagcaagtgtcatgcttcaaagcttatgcacaaatgcctggaaatggcagcattgcatcaaataggtatattataattggtcagaaatagttcatgcatttatctatgaaagtgaatcatttcaaggaattcaaatgcctagttctaatgtatttactttcatgtagacaaaatgaatggatacaattgtctttattttaattaaacccaggtaaagcatatgcacgttgctattgtattcttttttattttaacatctgctttttgatggatgtatatattgaaagagtgacaattataaaattgatttccttcaagaaaacatcctttaaaggtggttaaacaatgacatttaccttcattactttttggagttactgatccatgaagtaaatatacaatattgttttgttaggttatacagtggtcttacttattcatgtggatctcattctctttatccaagtacatataacctaaattttgttataattgcattaatgaacattacatcagggacattgtattaaaatatgatggttttgtctcaaaattagaaagacaacatttacaatattgttctaagtatcttaaactacttgaattaattgtttcatgtgttatatttttttacccattttctgattccccaagaaacttagaagtatcaatcattttatttgttgttccagtgatttgggctgtagtatcggattccacatgggattagagcaccattagagagaaatcaaatcttttgcacaaaacacaatactgtctctactagcctttagcactgcacaaacagtgataaagggatgacatgactaatattgctctccttcacatgagaccaattgcttttacaacttaagggacttagtgtagaactttctaattttagctttaactcctttgaaaggttgctataaatctagagaatcttatcaaattgaacgtataatcactgtgtccttttatatttatgcatgtgtataatagactcctttctccaccaaatattaaggttatatttgccagaaatgcaatgagctaatactgagcataaatatctaattcttgataaaatattgaagttttgtgaaagattgttctttatgtagatctggaagagaacaaaatttaaattcttttaatagaataactacgtttagagaaaaatggattcttttatacttccattcaatgtaaagtttttttttcctttgatcattgatcatgttgatcagtataagtgagccattcccacttttaaactcttaatacattttatttaaaaaataatattttattaatttttaagaatttgtgcattgtttatattcaccccgactacttccagatctactttcctttccatacacacccaactatattccttcattttttttatttaaatcattgagtctagtttatgctgcgtatatactcttgggtatatggccattcattagagtacagttcacataccaggaactatacccttaatacaaacacacacaaataactgtccttttctagtcgtatatcaattatcaataggccctggcttaggaatggaacttcaggctcccatccaccactccatgctgggaatttgatgatgtttagcttgaacagttcctgtgtgtactgtgatagctgctgtgagttcatatatgtatttgctttactgtgtatagaaacaccctttgattgtaatcataaactgcgtctggctcttacagtctttccagctcttcttttgaaattatgatctctgagccttgagaagaaagagtgtgacagtatgatatagatgagcacaccactatctcttattctctgccctttgatgagttgtacttctacatgttaatcacctactgcgaaaagaaactaatatgatgaaatttgagatgtgtatttatctatgtgtataacagtgtcacttggagttggtttaatactaagtccattaagcagagtaatagaagttctcctctagggcctatgaacttgtctagccacaggttcttgatactgataatggtgccaattatgggatccatattgtggagtgggcctcagatccaatcagatagtgacatttatggtacttttgtactagtagacattccttgccaggcctgtatatctagctcatagccaaacaagattcttgattgattttctccttccgtagtgtgtatagcaccttctaggattatgatagctagccagtagtgatgaaacttctggatcaataccagttttgatttctcgatgttctatgagtcatgaatgctttgtcttcagcagtacacatttgccatcaagttctgaaggatagacaagagcaatggcaataacataaattcaagtttgtgcatgaattataactcccaccccagtcacgcagacacacaccagtataatttccatggctttacggtgtgaatcggtagcagtaggtattgtcagaaggaaatgtatacaaagttttgaacaatatcatagctagtaatgtaatgtgagctccaaatatttaattttgacatctttgttttgaaataatcaacaggtgatgtatagtatgggctagttttctacatattttgcagaattacttttcattaaatgatgaaaagttatattaatatttttgaaatcttttatgcctaataatatactttggcctaaaactaatactatactttgtacattcagggatttgctttgtaatacgatagaaaataaatattaacttgatcttgctatcttatttatattttccattccattcaggaactgttctcaatcctgcattaaatgaacatgaaaaaccaatttcaacctgtgttggtagtgctggtggctaatcccaatacttaacagtcgaaagcaggatgaatgaagatttccagaatacaaaaatatacacatacatgaaactcatgcatgcatatacgtatacagaagggatataatacatagaattagaatctgtatatattctcctataaaaaataggcatttatactgtgtgggctcagttatcactgtgtgggctcacagagtatagcccattgatggatggtggaatgttttcttaattgtccaataaactttggaaatggtctttaaattttaacttcttcagtagcataccagattttccactgtttaatacctactgccactttttatacatatggttagagtaatgtctcagtgctaccagcacctgggaggcagtaacaggagaatcgtacttagtttaaggcaagcttgttctatacagtgaattccaggacagtaaagttaacatagagagaccctgtctcaaacaacaaaacaaccccacaaacaataacatagacaaataaacaaaaacaaagaaaataatgtatttcctggcttctttttcatctctaattctaccttcttgattacttgcagattaaacatcctgcatgggcttctcttgtctttatttagttctattgtgtcctttgggaagtttcacaagcagcggcttggatgtgtgtcttgtagcttgccaagagacctcctaatttgaatgtctcctatttgcaaacataataataataataataataataataataataacataataataatatactccaatttctttaacatacatgttctttttctttactcttttttgtctcccattcttgctgataaaataccttgcctgaattttttgtaaaaatttcagttagactctggatctgtttctttagactctggatctgtttctttgatttcttacgacagttaggatattaaaaatcaataacatgaactgtaaaatatcctacagaaacttatgaactagactgtgagtaatgaatgcatttatattatgttcatagatacaaactcaatgtagttgcagcaatcctgaattcttccatgagatcttggtactggtcctattgtgtggtatgtggcacgttatggtacactcatgtaaattgtgtctcaggaaaaagggaagaaaaaatctgtttctagatggctattgaatttaaatacagaatattaatcatcattcttttttccagcgttattgtctatatctctcacaatttatcatccatagtaaatcagaaattcatatattctggttgagacaacatgggaacatttatgtctaaaagtgtaataatacctgagtcagattttaatgtaatcatcaactgtattcttgtgattctgcatgccccaattggtattctttaagagctgcaatttatgcattttgtaaaacttgtcagccttatgtgattcatctggatttctgtactggttctgtgtgctctggtagtgagagtgtttgtggttgggagtgatgtatatagcagtctagagttctgagcctgtgtcttgtttccaaaaagggttcctctacttcttaacaaacctttcctatgccactggttgtgaaattgaccaagcagtaagatcacttttaattacattaaaaaaatacgttgctgctatctcaccacccctagggactgatcccataactcttgagctggggctccataatttgaagtgttagcacattcaccgtgatgttgattctgctggtttggggtacataatttcagcaactcttacttttgttgttatagtaaaaacaaaacaaaacaaaacaaaacaaaaaaacaacagcaagaaaccctgcccagccatgtgtacaagccaacattttgttttaattaagttaaactgtttctttctgtcttttttgtctttatgtgtttttgttggatatgtgtgcctacctaccacaatgaatgcacagagagattttagctagaggctacacagtgcttaatgcctgcaagacagaaatggtgttggtaaaaatgggggcaggagaatacttacttagttcctatgtatcattagggtacatcatagttagttcatccccctatcagcaaactactcttgggggccatttctactgcaagaactctgagcattctgcttaggcttcttcttcccattggccagatgattcttcagttgagactttgtactccatcaattgtaagaaataaacttgtcctctcttacgtttcataattgtatcttttattggaataaaaataattttcactgagtgaatccaaaatgcttttaacagtgcattttgaagtctgggatgtgtgggtggctgatttcaaatgaacaaatataaatcattctcttctatcaaataatttcctagaggaagaaagaaacaatcctaataattttaatagtactgggtataaagaaaatatgagtaatatttagcattttgaaaactatttttgaagtgttaaatttgaataaatttttgatttccttttctcaaatgtcatgggagatactggaagctgtatatgtagatttgtttagactatgttaaagttattgttctatgatgatttttgaagatttctctctgatagatgaaatacagcgtgttatacttaggactgatgtctctatctctctgccactactccactgattattcagagtctttagagaaaatagctcattgcaatggatgattacatgcctcaattgaatggtagctcattgccagttatcattacaatgccacgttgatttcttctttccattatgaaaattaaagccacattagtttaaaatgagcttccatatatattgcggatgactggttctgaatctcagctattttaaattataccttcttcagtaatctgattgctctccctggtaatctggtagaaatatagattcttaaccatgctgatatatgcctcttagatgagagatagacaggcagtatcataagttactttttgattactgtgataatataccatgatgaaggcaacttatggaagaacaaggttacttggggggcttacattttcagagggttagaatccatacccaccatgccagggataaaggtgacagtctgacagtcatggtgctggagcagtagctgggagcttacaacttggtctagaacattaatcagagagaggtaactgggaatgccatgatcttttgagaccccaaagcctatcccactgtgacagccctcatccaacacgccacatctcctcattcttctcaaacagttctgccaattaaggaccaaagtattcaaatatatgagcctatgagggtattctcattaacctccagagaaaatttagactatgaaatgtaaatatacacatagtttcaatatatggagtatctcggtagtacatatactgcaatggtacagtgtttgtctagcatgtatgaagcctggtatgttctctccagtgttgtaaaatttgtgtatatatgtagttagtagcaattttaatggctatttcataagcatctgtgtatatattttgttttgtgaaatccttgggcaatatcagattgcctatctgtggttacttaagatactaaactaaaattaatatttattgattacaaatatgtcatatagcgtatgtaagctactctaatgggggcaatgatgatagagaaatgactaagtaaagacactctctttagggaatttataatttaaatgaatctgtaatgtatgtgacaaaaaccatgtcatacatcaatagaaaacattatatgtaggtgttttaaagaagaacccatatttggttgacgatttccaagggctggagagatagttaatgatttaaaatgtttgtttgatgcttggaggctttgacatataatattgtggtttccttccttgaagataggataaataagctaacaaagaggttcagagagaactccagtaatgatcatttgtctgattatttggccaatgtggtataaattctcagtctggaaaggtagatcgagacttgatgaaactgttaggctgagtagatattgaggtaatccaagtgcattttaggactgaggaatatgactaaatgttatcagtcagatattttaaatgtaaaatgaacaaaagcaaaaaacaaaacaaaacaaaacaaaacatcttaaaaaaacgaagctacacagaaccccattggtttcttcagccataagataaagttaaccaggagtaaattaggttttaatgtaaacaatgaaaaggacataggggcatttagaggaagccttatagaagaagaagaagaagaagaagaagaagaagaagaagaagaaggtattcatgattggataagcaatgagctagtattctaacacaactgggatttaatcttgtgctattttcccagtcccactaatccatttcttcctacggatgttgtggaatattcaaaacatagtatttaaaatctctagaatctgataatctttgtactcatataatcctatttatcttcagttttccttttaggtagaatctttcaaagatctttcccaggctacatattaaataaaagcatcctggcattttacttgtttagctaagtttattttacttcattgcaataaagcactgatgtttatataattggttaattatttattatctctttatttgtaggtagtagactctaggaggataagggcttagttatgttgctcattatatctgtattacatacatacttggtaccttgtaaatgctcaacggctgtttatgaaatgagcagaataaatgaaaaggtgaaggacaatggcaggtcaaacaatttagccagtatttcaggtttgagggaatcaaagggcaatggtgttactgagagaatactgtagagtggaggaagagttgatttgagggagtagaaataatggaagatgaatttacctcataaattgtggcttaaatatgtgaagctgtactatctaaaattgtgcaatataggggtaaggaaactatgaagagaggtctgagtttcagatgatgatatcagggttattctcagcatcaagccttttatcagatgataaagataataataataaggcaggattatcatatttgaaaagaaattttcattttaatatcttactgttaaacctgtgaagttacttatatattcttttccactcatagctgggttaacaactttggccatgaaggacttggactcttactggatgctctggaaaagcttctagacaaaaaacagtaagaatgaagttttaaaaaactttcacaaaaaaacttttcacacatgggaaaaatttacgtacaatgtaatatttttttcttttttcttactgacttaggcaagaaaatattgacaagaagaatcaatacaaactcattcagtgcctgaaagcgtttatgaataataaggtaaatggtgtttacttatccctctgttacaaaaggagagagcttgctcgacagtatggaagtaagaaagagataaaacagtgggtactattcaagttttaataatatgtttatggtgtagatcatcatgagtttcctataagtggtttcaaaggtgtattttgcttcccgcaatatttactgccatattttgcatttatgacaagaatattagtttagctttcaaatttgttgacacatatttccttttgtgatataatgaagtctcattttttaagctttatttatttatgcatgttgctagatgagttgatgtgcaggacatgcctacaggtgcccattcaggatagaaggaatcagatcccctagtactccagctacaggcttgagctgcctaatgtgggtgctgagaatcgaatctggattctctataggattaggtactctcaactactgaagcatctcttaaaccctagcagtatgtaaatttacatttcataaattgaatatcatttccatacaaagaaagaagttgtattttatttaaaaggaaaattcaagggtaggaatagggttcaaatagtttgataagggtgtcatttcagtttcagtgatttaacatgtgtaaaagaaatctgtgggagatagcttgcatttttgtatacatacaatactatttttaatatataatattgtggagtcttacagattaaataactgactaatatgcttaatcacattaattacatttagttgatattttaataaaaacaattacttaatagaaataaataattatagcaataaccaggaacttgctaaatgtgagtgatagctattaataatcaatgcagtaatactgtatatttacataatatacaaacacgttctttggtatatgcaattatatatcactttctgtatcatatgcccatattactcagcaaatggtattattggtacatgcagtacatggttgctaatgaactctttcatcacatatacttttactgctatttctataagtttattatcattttacatttaattatggatatgcataatgcaccaatacatacatgtgaagtccaaagtacaaattgagggtttcacctctctccttctaccatgtgggtcccagggatccaactttaattttcagacgttttatcaagtacctttatcccaggagctaccttgcttacccatctgtatgtttcttgtagaaacactcctatcagtactggtcgagaacttctcttcttctgtgcttttcacctttagatacaacacgtcatggcatccaatgactaataacaatacgcttaattgaacattgctttctccagagctcaagaagcatctctttctgcaactgaaaaaagttgtaacattacaaaaagagagggcagtactggagatcagagatgcacatcacatttccagtcctaagcagacggggcctttgaaaaatgacatagcccctggccaatcagtctcctcctctgtaaattcagcaatgggagcttttgtgctacatttttattgattcatgttgtcaactaacatagttttgtaggataacaactaattataattagaatactgactaaagtatgttatattagtttgtaggacttcctttatagccctattcccataggagatactcagatatggcaagactcactttctttttcttatgtgtttttggcagttttgaagaacatgatgatttcatttaagttattcgaaacgaaattggagtttttgtgaagctatttttatgatttagatatatatccttgtcacatgaataaacaagtcctttaaatgatagtcatatgaaacaatgcataaaacagacattctgaatagaaagcacacagtgatatattcactttaagttggaatacattttccaaatcgaggagggtaaatttcatctgaaatgacataaatgacacttgacgttgaggttagttatgtcagaaactcataaacatttgcatgttgccttatgtgttaaagcccacagtaaagtcttatttaaaaagtttagcctgctcctcttttctcttagaatttaattaagaaccttcatgctgttcctatgtttggtactttgccaaatgttatcatataatgtttcccaatgaaatgtaatgttgccatggaactaacttgaaatgaagcaatttttttcagattcttaactgcttatagtatagcatattgattataagtactgaataaatggacaattttaagaaaacatatgcactcacattacaaaccaagtacagataaactacatcattaaaaactatgatagtatgatacacagcatgttcacatggatgaggaatttgtgggtgtttctgggtgaaacatgaaaaaagcaattaagaattttaattaaaatatcaataaagatgtcacaaattttatataaaatctaattcattttatatacatttcccaagaacaatattagaattatgttttactacaagaaaaatataaatgaattttacacccacagctaaacaccgaactgaactggaatccagttgcagaggagtgatgagcaaagggatcaagaccaggctggtgtaacccacagaaacagctgacctaaacaagggggagctcttggtccccagactgatagctgggaaaccagcatgggactgatccagaccccatgaacacaggtgtcagtggagatcacagaaatctatggggttgttgtagtagatcagtacttatccctagcataggaatagactttgggagtccatcccacatggagggatactccctgagcctagactcattggggtggacctaggccctatcccaaaggacatgatagactctgaaaaccccctatggaaggcctaaacctccctgcagagcagaaggggtatgggataggcaatgtgttcgtttggggggaggcagagggaactgggattgacatgtaaaataatcttgtttctaatttaaataaaaaagggagagaaaaaagaagcaaacttttactgagaaaacagaaatatactttgtgagacaaaggtgaaaatagtagcatcttaccattaattttggatttgaaaacctacctattggcatttgtatggcatgtgcttatacacttaggtttatgcctagaaaatgagtgagactaatattttctttgcctgtctgactggggtatgtctctgagtctataatatgtgttgctagctaagagatatgatataaaaggacaaggaaatcggggaaaacccatatcatatttttagtactttatcgactatatactatacttgaagcacttaagcatttttccctcccgtgtttactttaaatttcagtgcaaatatattggaaaaaattaaccacaaattctagacattcccaaggatatcaagacattaaaagtagctttagaaaatataggcagtgtatgttctatatgttcttgcttgttagacaaataccagttgttcccacatttctcctatatattttcaaaaatgtaattgaggaatattggaaatcatttttattcatgccctcaaatttctaagatgtagccatttcaaataaaataaaacaatgaatgattgcatttgaggaaaatccaaatcattagatacctaagggcactgtgaaggtattttttttgaaacatttctttattttgggtttatttggaatgaaaaatatgttccatagacattcccattgtgtttgtttttagtttggactgcaaaggattctaggagatgagaggagccttttattgttggcaagagcaattgaccccaaacagcccaacatgatgactgaaatagtaaaaatactgtctgctatttgcattgttgcggaagacaacatgtaagtatcgacaggttctgtttattgtgttgcaaaatgacatggcagaaattaatggttcttctttttgataacttgcagaaacacagtagttcttagaatatttttggttgatatccttattttgtttgtattttacctttttggatattatataatctgaatttgttaaagatgaatttaaaatattcatttattcaactggaattttgtctcactgaagataacatcagttaagtggaaatggattaagttgaaaacgttttgagaacacataggaaacacacacacacacacacacacacacacacacacacacacacgcgtgcacatatgcacatgtgtgttcaggcatctttaattgaaacaggtatatcctttgtactattgtatccttgtattttactttatcttatatggtaacttaacattaaatgaacttatccaataaaaagaaaacatagtgtaagtttgtaggtaaatgtttggaacacaaacaaaaacagctcataaaacattagcatatgatagtaatatgtatattaattagctccagttagctgttccatagcaggaatatttttaaaaacattgtattatatactaaaaatatttgaaggttttgtctattaaaagtattgtgatgtgaaacatttaatggtctatataaacatcaaacactaagaataaaatagagaatgagctatgttcatcatatgaaatattcctcatttcctttttctcttgttttgtctgtagtctagacaaacttttaggggccatcagtgctgcagctgaaagaaataacagagaacgattttcaccaattgtggaaggattggaaaatcatgaagccttacaactccaggtggggttgttttatcataaatcacttgaagagttatatttcgaggacctgtattataccaattcatttttagctggcatttatgggatggaatgtaaaagtacaattatttgtgttactcatagttttgttcatttaaagtcatttaaaattaagaaaattgcttttttattgtcactaatacggcatatgttattataattgtcgggaagttgaagctttagcagtaatatgggccaaaggacatacagttaggtctgtagtatttgaccaattaataaagctataggcttttgtagaaatgtaagaaaatagttaggtatggtgtcatagtatggtactctttagcagtttgaagtctgagtcaggagggttacaaggttctgacttgcctgggtttcaatcaaccaaaaaaacaatttaaagaaagagaattcagtatacttctctttgtgcctttcagacaatcagaaatcagactcactaatgcagagggactgaattgtatcccgtgtcaggcaccctgtgaaaactctgtagacccagtctaaacatgcttagttctaaaactgaaaaaatcttttgtttttcatgatttcaggaaatgtcttactttatgaaaggatacattgttcttgagggatgagaagtcatgtttattgcctgtatttacagataagagctgctgaatggcacattttattttgtgaatataatttggtataattcttgtaatgaatcagctccctaagtattatccatttatcatgtggataggtagaatgagattgcatcacttgtataagtggacatggtgtggaagaaccagaatttgatgtcaacatgctctttgttttagatagtgtatataccatttgatgctccacgaagtatcttttaaaaagttatatcatcactcaaagagattttgctactatgtttattttttcaagttatttttgtgagtatacatatggaaatattctacttgatgtgaaacaaacaatcgattttttttttttattgttttatgaagtattggcatcttttctgtcacagctggaaactgtgttcggcagctgaattggccactccaaggagaatctgtagtactgtgaaactgtacataatgtttctttagaaatgtaaaaatatctttgaaaattgttctacttcaacgatgatgagtatattgataaacttctgttgtattctcttttgcattggtgtttttaaaattgagaatgtccccttagtgttttcctatctgtgacacagttttccatattattagttttagtttcactaaaatttcatactttctagggaaagcctgagatatgcattttcagatgtcttctccagtgttttgtccgtgttgctgtgttggctgtgcttgcttgcctagatggctttcactgccagacatacatatacgcctgtatgttattttcaaaatttagcatgactcaagcttgttatttagattcaaagttttcattgcatttgcaacggtttgccatatgtggcacaaatagatttgaatagttaaaaatatttaaatgaaatttcagccacaattctgtgttatatattaccttaagtttactgatcagggaactgagttgcacgaaggcttcatgattagttctctaagaatcacaaagctgttaaggtttagaatggtggtttgaacttaaatttttgatatatacatcccaaattatattgtatgtccattatagtaacacctccataaaaaagcgatgttttcattgtagagtagtttgccccagtcagtgaaactttactgacattctgtggctttcatggtgctgtacagaatagaatgattaagtcgcaactgtttaacaagtaccatatggagaaattgcagacatcttgctaaatattcaagaaattgttgaatactgattatggatgcaaacatatgcaaactacaatttgaaatttcctaatttaatgagctacaacgtttagtaatttattatatacagagcctagtactctcccaagaattgtgaagtgggtttattaggcatatttaatgtgaatgagaaaatattctgtaaaagttctaaaatgtgttcagaatactgaaattaaaaacaaaagctgagctctgttgtttaaaaaatgtaatttgtgttttttttttttttttgcagaattacttttcaattttggtagtgtcctgagatctcttattagaatatcatgaagtaattcttttaaaatactgaactaattatattttaaagcaacagtttcttacagatgttttctagctcagctatgataggattttcattactttcagtagtttcaggaacagatcagggataaattacatcaacatatgtactctcttcattgccttacgttcagcttagttgcactattcagtctgccatgctgtgtcacctgcagttttacacttgctagcctctcatctgcctttttaccttgtagcacttgtctctcagagaacaatctatacttctttcctctattttctaaattatctttcacaacttatctttgtcactgtcttaaaaagaaatctttaatggtctcataatttcaaaaccaatgatttcttcccaatggtggctttgtccactgaccatttgacaattttacttctcttgcttctctgggcaccactctttttgggtggtgtctgaatacccatttattctgtttctaatgcatttttgctcttcttcacaagaatatttccactattttttaatcactactttctaccaataatcattttatatgcacctacttatatgttgttatgtgtatatgtgccaacatgtgtatgtgctcataaatattcatgtatattcatgttttttatcagactcccacaagtaacaaattaaaaatatcacttgtgagtgctattccacaataacattgcaatttacatatgtaatctcatttaaattacacagcaaatctgagaattatagaagtatctcatgaggtgatatttgagttggctttcaaagataagaatttcaatgatattatgttttctaataaagaagccataataaatttgaatggtgcaagaagggcttatagtgcgtgaaaatggagacctccatagtctttgtaattttagaaatgaaagcagaagaccatacagacatccgcttgaactttatttctgtgtagcaagacaggaaatttcaaagtaagctaaccattagtagtcttttataggtagagaaggtaacattaacatccagtgaatgcatgttaaactcatccattttctcaggctacagttaggcagaaatctttcatgtgtttgcagaatttcagaagttgtggagacaaatgtggtagcatggtatggtagacattaaactgctttctagtatatcagaataatggagaaagtcttctggtataataattgaatatagtacacaaaagcatttcacacaatgtattgttcataatgtgtgatagcttctctcaggtatactacatttacattgtataggcatcctcttggcatataaattagaaccaataatgaaatgaaggtaaaaatcaaacattgatccttcattgaaatcatcaagtctatcaaaccggtttcatgaaaagaaagacctggcagcctttaatcagaacctaagtttgttttcttgcattatcatattgagactgagcatctgatttctgttcatggcagactaagggcacaagttggaagatgtgcaggaagggagagctaagtagatgtttagtaaacttctgaaactaaggtaactgccaatgagctgagttccaagtttatactacttccgtatgcatgtatatttgtgtgtgtgcatatgtatgtatgtatgtatgtatgtatgtatgtatgtatacacgtacatatacacgtacatatacgcatacacatacacatgcacacatacatacatacatacatacatacatacatacatatatacatacatagtagtgtaccattgtgtagacaaatttggacaatagtgttaccttttcattgtaacaagaaaaattctgacttcaagtataccttcacttttaaatctgtttcaaagatgatgaataattgtgtatattattacagtagtaggtaagagtgattctaagcgtttgaaaaggagcagactactttcaaagctatcacattgtctttctagcactatttggcattattgagcaggactacacatacttaacttgtgcccgtccttttcggctcctctgtgctttcgcaatgcttcttttctgtgctcatctccttcttcttctgccagtatctgccatttcattttcatgtcaaaaatattcacgaacctccctcttaggataactttttccaaacctctcatggatccctttctgattttaggatctatgaccccatatacacctgtgaaaattcaaaccaaaggtttgtgcatacgagacaaagttgtatcttgggacctttggttcttcatttttctcattttgatgatttgcccactgtcttatccatctttctgagttcagcgagatacatgtttgcctatgctctttgcatcccagtccattctccctttcaaacatagaatgttcaagttctgcattacatttaactatgttcatcttcaagttatacatcctgaacctctctaatgtcttttctcaccacgacctaccattttcttatattccttccttcctgatcattatgcaagaattaacatacaccaaaaatgtaatagttggcttcaaatccacctgtaatatatatatatagtactatatgtcttgcattccttcagacagtacatactggattgtatgttaattttgtacttctttcaaggcacagtatctctctaatcgctatgctgctgccagtagttattttttcttttaaatttcagggaattctctttattttagtctttgtgctgacttctttttattaaatcttctacccttcattctaaccctttaaatactctccggcaaagtcactcttctgacatgccattttggcacatcactacttacaattcttcaaaggctttttatgacttctaggattaaaatctagtctttgtgtccctccttcccaaacgaatagataaaagcacgtcaccacctgcttacagatttctaattgtgtgtttcactagtcttctgtatacactttttgatggagtcatactacgctctccttcatgaacattttgtgcaatttcctctctctacttctaatcctttgtacataaatccttcttttgtctagacattcttctccatttcttgacttaattaacttgcactgtacatttgaatagttcttagtaagtacttattttgacttaaacaatctttttcccccaactcctgctgtggctaggataaagaaagaccttgttaatgtcagcagagcacttaataaggtcaaatgtgtgacagtgtcaataaaattttaaaagcaatatttgtcacagctaatggcaatatggataatctgtctgagaatgccctagagttggcaattactgtactccataactctaagaattgtgatcaaacaggcagacaattttttgcactttctgaaacttgttagttgaaataaaagcttctcttattttcgtagttattttgtgaagacattcctgtatattttaattttattcatgtattttatatgcacttataagagcatgtatacatatctagtacatgggatgtttattaaatgcatatgaataaaatacagataacatcaaattttcctatgttaaaaacaatttaataagaacaggcactgttgtacttacttgtttagcataagaattatggtcctaccagtgcatatttttattcaatgagcaaaatttactgacttcctgtgatatttttaaacactattttttcattgactctatattagaagcacaaataaaaaatggaaaaaccacattgaaagttaaagcccttaaaaaaattcttaaaaacagaagaatctggttattggaatttgtgctattcaattcaagtacatttgtattctttctggtaagaggttgaagttaaattgtattcagcaatgctagattggcacattgtaatgtgtagaagactgcagtactacaataagtggtgctagtttcctctttttggcttattagcgttttcagttgagggagatcacttcatgtttgtaacccacatatgaaacaatattaggttgtttacttcttttctttggagagggattattttaaaatcagtttgattttgctctctaagaggacaatagagttcagtcacatgtttaaagatttatatccttgggtgctgagcatcaaagttttggtatttgggaatgaggtttgtagtcatttcagtctgagctctaacaggccagaaccccatcttccttaatgttccccatggagttctgttctgtcaaattttctgcagtattttttattcatattgtccaatgtgggacctataaatcacatgtatttttcatgccattggactatagctagtcaagtcaagttcttgatttagttcctattgaagttaatctgtggttaaaagagcctggtttgaatagtagagttctgtaatatacatgtacttgtatttgaatgcacattctcatgtaatatggaactccttgggggagagcaaaagggaaagaggagacattaatttgactatgggatgctctcaatatgatactttatgagatgtatatggaatgacatgtactccaaaccaaggatcagttcgtccttacctatttttatttgtgtttcattatgtatttggtaactcctttatatatttggtaacttcttgttctagacaacatattgttacattatttccatgcttttataattatggatagctgtaatgtagatgttctaattcaccaaacatgatgctacagatacgttttgtcaccttatacaaccttaaaatttttcttgtattaatctttgtgtggagtttctaagatatctgaaacattctggaattgttttctacttgacataaaatagtgtaacttagaaatataattttcttttgctatttgaccttgcataagtcatttatcttctgtaagcttcaacttttccatgtgtgaaagaaatatagttgtaatttacatctcattgttttctatgagagtgactttagatagtacattatattaagcacctaatacattgtctaaaaatttataaaaattatacaatagagataagagtgtagatttttgcattcagctatttgtattttgtatattggatccacacaatgatatttcataataaattgttgtgcttcttgaaatattatttaaattttcatgtaagatattttgataattttagtttttaattcctaagttattgttctctgaaagaataactgtagcatagatgaggacaaataacagtttttttcttaccttactagtaagtgtgtgtttaaatgtaattccctaggagttttaatattgcagttggcatgttattaatgagagatcttgtagaatttggtgagccataattggcattttgttacctattcttttttgactactgtctttcagtcatatcctacttattttatatggtagactctatgttcacctttttttaaaatatccagccatgtttgtatacattatctgtaaagtacttcatagcagtgatatctttataatgatatatgatatcatgttgctgtagttagtaattttaatttttactattttatttcattagtacaatacttctatttctataaagatattgttacaagatttactaacctatttcttatgagaatatagtctttatttgtaaggtattaaaatatacattattaagctagaattccttctggcaaaaagaatactagcatatgtaaacatttctattaattttcaattgggctttgtcttgttaagtcatgtcataattgttacttaacaagactcattcaagaaaataatatagcactgcatacaatatataaacacatatactagcctattgagactctataaagatttattcaggttcttattgtataaaggaggggcctgtaatcaattagaatgaaaatgcctaacaacacatccagtattagttttaaggtgatgcaaagttttttgatacacatttagttgtccaaatgtttattctaggaatacctgagcattcctatgaattggaatgcagtgttcaattactttttctctatgtggtaactttgttaacaagctcagctttctattttaaatgaacaaacaaaaaaaaaacatttgaatttggtatattacatttgaacaataagctgagtgtataacattttgatacaaacttaatgcaatatatgttttaatgttttctcattgttttgaaaaatgatatgtaatgcaaggtgtgttgaagtcaacatatgcaatatttctatcaaagtttgttttcaacatttttggtttattcatctttctatatatgcttataatttttgtaaaatttagtattttccttgagtttccttgtactctactcttctgctcatataaacaaccagctacaccaggacatggcagcaccccagttctcgagcaggaagcagtcttgagaactctatgcccatgttccctaacctcccatgcttaactccccacctttttaataataagtaaaggtggaaatgaaaggttcaggcagatacctaggcagctcgaagtgccctttgttgcgttgccacgtcatggctacatcacacattacaggactgtgtagggagggagtctgcacatgcgcacgcttcccattttgagcctgcacccttatccctcctctctctctctgtttccagtgttcaaatgctaattattctctgttctgctatgctcttgccttcctctctctctttgctctctcactcgttctgtctctcttactgcctccccacccccacgctcttgctctcccaccctgtaataaactggttcatgtactctctattgtttggtttccatctagtggtttcttttctaatttttaaactcttacagaagaacaccacttacatcagtttaacgtacttccatggaaagaatacaagctaatacagtgatatctcaaagttatctaatatagcttcacaaaatttttgatttatactggaattttttttaattgttttcccgagacagggtttctctgtgtagctttgtagaccaggctggcctcaaactcgcagagatgtgcctgcctctgcctcccaagaggggttgagggagtgagccaccaccgcccagctggaaatgtttttatagctatgtagaaattagttcccttactatctgtggaaaccagatacaagaattcatttcatgatcttttcatagggttcagtgtgtattatttgggaacctgaagtttctttgggaaagttaatatcctttcatatagtttagcaaagcaaacacacttaactttcatattgttaaaattatgttggatatcataatcttgattgctaatgttgcttataatacgaagtcttatcaatatacttacagaaatacttgcattccatatgcctttagtgaatctgttacctgcatgtattagctaagtatttctttactgtacctaaatatataaatggcatttactttctctttttaggtggcatgcatgcagttcataaatgcacttgtcacttctccatatgatcttgattttcgaattcatttgaggaatgaattcctccgttctggactaaaagaaatgctcccagtaagttcaatgtttctatttattgtactactgaacttttaacttgttttccctttcaagtaaaggtacttttttttcaaggaaagcacaaatttgtcctttgttattgcttcaaaaaaacctgcactttgttaataatttcactatacaatggatgattcatcagtcagctaataataggatgtatataaatatgaattatatatacatatatatttgcaaatttgctttcctctttgatacttttgattgattttatttatagtcagcataagtatgcatattgaggcttgactagtatatttgggatattttgcttaaatatggtattcttattaggctgcttcagatcttttcaaaagagaaatagttttaattctttatgaagtccatagtaggaattagaatcctttgactatatgcctaagtgtgatataactgtgttatatctgtcatattccttttttactgtgtaaagtttgtttaagttgtcaaacatttattttattgaaaatgtatggatatatctttcagagtttgatatttgatatgaaaacttaccaatagatcaggattcataaatgtcacccacacccagagggcctactttggttccatgtaggttctctaggagctgtcagctcagagtctatgagctcctactagcactggtcttctgtatccctggatttccccattttgttcttgccccccccttgctccaggagatcagcccaatgcttggctgtgtgtcattgcatctccttccatcagttactggatgtaggttgtatgacaattaaggtagttaccaatctgattaaagaggaaggctggttcagacaccatcaccactatttctaggagtccttagctggggtcatccttgtggattcctgagaatttctttagcaccagatttctccctaaccccataatggctccctctataaagatatctctttctttgctctccccttcaatccttcccccaacttggtattcttgatccctaatgttcccataatccatccccaccattccaccctgcctcccagtttaccctcctggggcctcccatttgtgtccttcttagggttcccctttttacctagcttctctgaggttgtggattgtaatctggttatccttgctttacatctgttgtccacttataaatctggtactgataaaacagtagtgttgaacacattttctttgtaaagaggagaataagtagaattacttgctctgaaatgtattttttgatgttctgaatgtgttctggttgcaactgccttctgtgctcatatggtaatatgacccataaacattacataattttgtattctaataaacctcttctgcttgaaagtggctggttatatcaaaaagttcttagtttaaaagaaacaaagtggaaataattttatttgttacatgctttatatgagtgtacttaaaatatttaaaatgtattttaaatgttttatagggtttatttttatatatttaaatgtgttaacaatttggtacattcttaagtatggagattcaaagaaagaacatcaaaaagtgctttgttttgtgttttgcttccataattgccattacatccctatttatcattgttcttcttgaattaaaatagaaacaaaaatagaaagaagaaatgcatcctgttttctttctttacctaatttgaagtacaccttgcttgcatttcctttcagagttcaagctcagctctgaacatcataatcccagttttggtatcacccttgagcatccacagttgtgattatcgatttgagttttcaaagctgaaacttaatggacaaatattaaaagattttcctggtgatatctattaagcccaacaatctctagtctggcatgtttccaaaattttcatattattattatttggaaaattataagaggtttgtaatgcatgtgcttctgatgtattacaaaaacaaatctttgatgaccaagttggtattttgtaattaggctaaatgaaaatcaaagtttggcagggcagctagctatatcatgaatttaaaaaaaaaaaaacttagtaccttttaactttaaaatcacaaaatatcattcattataaatttgtttacaaaatttttctaggccgtacttgggactgttgtgcttgaatatatccttgcattggtttttcattaacacaactgatctttattgcttcattttctcggtgccagaggcacctgtgaatgttctaactgcatggtttcttttgtgatttctgatgagtatgttccgtcaaaacgacagcattgaattgggttgtagctattagtgggatttttgttgttgttgttgttgttgcagaagtgattgttaatatttttaatgtgaattgcaagatttagagcatggaaagaaaatgtaaagaatggtatgaggttcttccattttgaaatagaaatctttagctgtatttattttcttttaggaaagcaaggtcaatatttgaaattgcatctgtgtacaaatgagtaattttattctgcccctgattagcaggtgtgttatttttaaattgtcattcattttctgaattttattgttatattagggtcttaaagaaaaagagaatgatgagcttgatattcagctgaaagtgtttgaagagaacaaagaagatgatctaactgaattatcccaccgtctcaatgacattcgagctgaaatggaatatcctttaacaaacaaaataaatacctaatttttacacttaatgtttaaaagcaggacttgaggatattttttatatttcattagtttttttttctatgaacaatgttgtaactgcttatttatattagtgctccaccatgatgctatccttgatacccatttgtgctgacaattgctactttgctttgatgatgtattcagactattgaaagccacacaattaattactcagtgtattagagatacactctgctcagtggtcttgaataaacaagagcctaagagccttaagcagtatatatttccaagaatgagaaaaagttctttgagttcatatgtgataccagttaagagatattttgtttttattaaatgctactccacttatagatacaattttctggaaatgagtatcttatttcttatcgggtatttgtgttccttaatgatagcaaaattgttagatacaataggagctttctataagaaagtagtgctataaaagtacctacatcatatataacagcatataatcttcctgtgccaactgtctgatgtgaaattgagacataagatatgattgtcacagttctgcaacttatctccctcccattaaaatttatacttttggattctatgaagtaggaagacacttgcgaaccaaagtaacctctgagctgtgcttttctacctttaatattttcttatctttcttctttcggtattctaaacaaacttgaacaatatttccctatttgaaactcccttattactttatttgacttatgtgtttttatgtactcttctcctctctttacatgaaaatattgcataaatgtagatacaatgtatagaaatgttattatcataggaaataattaaaaattaaagtaattcaaaattaataaaaacagtttttaatcaataaactgctttatatttagtgatataatcaattatttgataattttgtagccattcaatgtccttatgttactttaactcagaactctgatgtggtgtttaaattagtgcattgtatatttaattctactgcccatttcatggtgtttcaagatgttggattgcatcttgtcttttacctttattttatgtggactttcaatatactcagtacatataatgtgagtccaatcttgaagtttttttctagactactaccagcatctacaccactagtttttatatcccaaagaaaaaaaaatgtcctaatgtccatggacttttcagaaggtcaagtatgaacacaacagattttagactttttatttgggtatttaaaataaagctaggtttgtgatcttttgatagctgaatacttgcttgatatatcttttatctgaggataaaaatagaatagccctggctcttttggacccatagagagatcaagacaaagcctccttcaccaatagctttgctatttgaatggtcctaactattatttgaagttgataatataatggatgattattattttttctgtagatgtttaaatgctgtatcatgaaattgaaaccttattaaccataatggaaactaagtagtaaatttttaatttaaaaattaggctgctttagtcataaatgcactgtccattaagaatctttgatgttttcctttactttctttctaccgatatgaatgaagtctaccatcttctctataacatgctgaaagacactgcagctgaaagttacttattatccattctgcagcactttctactcatcagaaatgattattatatcaggtaaggttcatatgtgagatgactacatgtataatttgaattggatattaaaaggaagttaacaaggtagtagggctgaggaaatatatatgttatatgtacataaaatataagtgttttactacttgaggcaacatttgaaaaaaagaattcatttattttaattgggccaggaaagataactgcatataactatggtgtgcatgcaaccagaatgtaagtataaattaacctgtcgtatattattgaatatgtaataaatttttctgcttgatactgctagaatgtcttaaatcctcctattttaacaagtaaagttttatcatttctttttatagtgtttagtaaatgtgtgatcttcaaattcagaaaagtattgtgtatattttactttttgtaaaatatgataacatatagagttatactttagaatagatgataaggtctatatctaaaaactggaagcatatatagcaagaggcttatgggtgactgaaattataggctcatgaccatggtcttatgttaatgacagttcaaggtcctcttacttgctttacactcttctatgtttgcaattattacatactagtttctttggattctcaaaatttgcttgaataatagaaaaagaagtgatattagaatgctagttgtattgttaacaaaaattgataattctaaaatagcatatagagctatttttttcttcattctactgcagtgattggatcacatcatgatgtttaggagacagaaacatgttgaaactactaatgcatgctttttaaaaaccactataaattaaaatacataattttattatgtatttattatgtattcatgattattcagttacctaggaacaagatttgccagaagtacctattctcaataaatactaataaatgataaaacatttacacatggcatccttaaaaattttgtgttatatgagtatgttctctctctctctctctctctctctctctgtgtgtgtgtgtgtgtgtgtgtgtgtgtgtgtgtgtgtgtgtatgtatgtatgtatgtactatgtttgtatgtatgtatgtatacagtatttgtgtaattttgtttccgtgaccacagacagaggccagaggtcaaattggttgttgtgctctgttactttctttcaatttatcttgagacagtgtctttctcactgaaactggaggactactgtcagattcctttggtccttctagcaacaccccagacagttacagatgtgcatatccatgcctgcctttttacttaggttctaggcatttgaactcaggccctcctacttgcacagctagtgcttctatctactgagctatctcctcagccaataccatctttcatcttaaggcattcctgtgaggtagaaatgtgtgacaggtgctttcattccatatgtagacttaataaaatccccctcaaagagaagagttgtgtttttcttagttatccaaagagtgctcatcacactgaggttaaggactaatactattcatctccagatctgatggtgattttcaaatccctagccatgcaatacgtatttctttttattcttagtcttaggaacaaccacatgattaaatacacagaagggtaattagaatctctttttcattggtttagagtttttagtaggttgacaagctatggttagtggtgtttatattgtagtttgtctgaattaatacttttctacaatagtgttgaatttattaaccaatgaaaatttgtctcccacaaaatttaaaagcaaaatgtcttttatttttccttttccagtcagcaatcattattaaggccagaattaccttgggagattacggaagtgtgatgtgtttttaaaacgtttgataaatcacacaaattactgctatagctgtgcctattaagtgtatatggcttcataaaatagatgttttttgaagcatgttgtatacataggtttttgcattactgtgtaacagaaatgcctcagtccagttttataaactggtgttactgtcctgagtaaatgttcttcactgaattcaagacattgcttgccacctaatgccaagaatctcatctttttttgaaaatgagtgcttgtggctgtctagagctatttctgtgctcatagatataggactagggggttattcattttcattaactttagaaacaataccttaaataaatagatggggttgataagtatttttgaacacaagcatgagtccctgcaaactagcatattaagtcagtacatattttcagtcgatcacatcacactcaatttggctccctaatgttcagaccatctttaagccttaatcatattttctctaaggaagtgcaaatgttagtggaattattttcttattggtgctggagaaaaactaagttcttttagcattctctatcccttcataagaaaattgattgatacaagtagaaaagtattctcaaatattttctctcctccttttaggccacagtattataaaataattgaggagtgtgtttcccagatagtgctgcactgcagtggcatggacccggacttcaagtacaggcagagattagacattgatctcactcacctaataggtatggattatactctatactgccattcatgggtcacaccttctgtatactgagcacattgaaagggtaggtctctcactgaactctcttaaaatctggtaaatgtttgttgttatggatgctcaactaatacaactatttgttttgagaatcataagaattctctttataggttcagatatattaatctttttgataaatttcactaccacatagtcagttgacaattagttgtcatgtgtcacaaaaatccatgattttttttttaaataggtgcatgccttgctgtttaaaagcatgactttagtatcttttagttcagttcatcctcacagaaagattggggaagttatatgtgcaggagagtctcagtattatagacatgttactactggctctcaaatttgagaaaagaaatgtcatgaaaaagaaaatagctcaagtaagaatgccatgtagaaacattgttgtaacagtctgatcagtgatgacaagcttctcttttgctatatgttatgctctatggctctgtagtaggtaattgtatttatagatggttaaaactatcattgactaggatgaagcatgaagttgcttgtttttaatgaataaaaggttgttgaataccatttatataatatttttcactacattgcagaggacagactcacaaaggagtcagagatttaacattatttctcataaataattttttgtttcttactataggcaatttagagatttctgtaaatgacaaatatcaactgatcaagatcactaccttttaaatgaatacattttaaatagccctttctttatgcacatgtctgcctttgaatgtaactacttctaagctgaattttcaatgagcactgtgaaggtttgactatgtttgcattcaaattggatctgctaactacatgtcatgttatgatctatcatgattatttgaaatactgttcagttattgttttctgttattattgcatctagattgttttctcatcctcaagattgtaaaagaatctgctaattgatctctgtcaccaaaaatgtattttaatactcagcttaattgaacattctcacatgtaaatgctggacattttctcactgctttttcacagttaattgttatcagtgaagataggaatttcaaatgccaaatatttttagaaatcttgaacctttaactatgtgagctacaacctcttctagttgtttttgaaaagttgatgattattgtggaactttcattagaatatccacatgcaaatacacatatacacaaagttatcaagggcttcaccctcctccataagatgcaggggtctctatatgaatatcacttggacctgagtattccagtctgggccgatttcacatttctgtacatcaaatgttttttcttaaatcatagcagatccttttctaaaactgttcaatggcttccattggaacttagatagaaatcaaagtaaaaatcattgtcagctatgacttatattgcccatataaagccagtttggacaatacaactttcctgattgtatggaacattctaacatttttacaacatgaaacacattaaatacttgtagccagagagagggcttaggagttaagaatacttcctggtcttgcagtggaccttggctggacacccatcacctacatgacacctcagaaccatctgtactctgcttgatcctatgtcctcttctggactttgtgggcactgcaaacatgtggtgaacagacatatattcaggaaaaagatccatacatataaaataatataaaacaatcaataaaaattgataaaaatctttcttatacatttgagtggagaaaattacttatattttaatatataagctaatcaatatatatatagctaataaatatattttaagtacattttttacactttacaatataaattaataaatgtatacatatattaatgcattgtgtacttaaaaccatcattgtatttaagatcataagctgtattaattccttaaaaatttgctgtcttctctccttgtttttccctactctactcatacactgggtatgtcactaaaagtgtcattgaaaatagaaatacctactaatctctcttatactgactttattttagcttaattttctctcaccagttttctttactaaaatcttatgcaactagtgtcatgtagcaatactatctgtgactatcttgtttcatcaagcatcatatgtttgagattcatccatgttatagttcatctattgatagtttgttcctgtatattgtgaagtagtatttatgtatgaatattaaacaatgtgcatttcttggtggacagttttgttctttccagtgttcaactattgtaataaagctgttatggttcatttatataaatgtgcaattcagacatatgtttcattttcctttggagaagtattggggtaatgcacatggatataatctaagattaaagaggtttttgcattatgtttattaactaggcctgaataattttatgtttgcttccattttacaacatacagaagtcaagtaaaagattttccctgaaaacctgaactgaagaatgccactgcgtcatcctccccagcgttttagaggatcattttgagttttcattatcttgaaaatggagtttttgcctccagtctctatataataatgtgtgattttccaatgaattctatagtggtaaaagttgaattataattaacgcctttaatttcagggacaatttcatctaagatatttattaatgcctgaagtttttgctttaatactaaagaaagaaaatgtggtattatttgtatattataatgtagattaattttcttttaatgataattcatgtgagaatttcagaattatatactttcagccataattagctagatatttcatctcaaatatttctaatcatttttgcttcatctgaatagatgcttgtgtaaacaaggcaaaagttgaagaaagtgagcaaaaagcaatggaattttcaaagaaggtaaatgccaaaataatagtcctgcattttaaattaatagttcaacccccagtatgtaagtatgtacccttaataacatttgattttgtatgacactttataacttgt

SEQ ID NO: 3 - DNA, 414058 bp, Cricetulus griseus
  misc_feature (16047)..(16356): n is a, c, g, or t
  misc_feature (56000)..(56014): n is a, c, g, or t
  misc_feature (112642)..(112675): n is a, c, g, or t
  misc_feature (373665)..(373906): n is a, c, g, or t
  misc_feature (387573)..(388011): n is a, c, g, or t
cgacggggggggggggccatcgcggtgaccccagcagtggcctcgctgccgcgcgccgtggctgagccgttccgactcctcggaccccccgggccggatctcacccttgcgcgcagcggagacagcggaggcggccacgggagcgtgaagcagcatgtctgacaaaatgtccagcttcctctacattggggacatcgtgtctctgtacgcggagggctcagtcaacggcttcatcagcaccctggggtaagtagggcgcgcactgggcagcgccagccggtccaggtctctgtccctcccgcgcggcgtgtccggggtctgcgcctgggacagccccgcgtccccgaggtccccgcgctcaggaagccgcgagcgcttctcagcaacttcgtaatctccagcccgagacacatccgagaagaggaagtggttcgcacgccccagacaggccccgcgaggcagccttccctggcgtctcctggcttgttttgattaaaatgtatgttttctcctcgtcttccctccccacggcccttctcagcgcccggctggaaagagtggtgggttgaagtccctggcttcggccacgaaagtaggcgatgttgcacagtgcaaatgcggcattgtcccgctggaggagatcaccagcccctcttcgctgaagtaatttccttttggccttgccaagggaagactcacccctttggctctgccaaaacgggcctcgtgggcagccggggttctagaactgggatcttcttttttcctctccatccccctcggccgggtgaagtgaactgcaaggctctggagattccagttggtgtatgcactggggaaataggtttgtgtatcctgcagaacaccagcgtgctagttaagtagggccttttgtgatttctagaaattccttacatggcgagctgatgcagttagttgcgccttgcgatatgttttagtgcacaggtgagtttccgctctttagactctaatctgggagacttgagattggtgactgttcactgttgagttttggagttctgtctcctgagctgtgacagtgtcacctgcccaatgccttccctggaagtcaccagtggtgtcctgttctttgagcatgtccccacagatttgggggaggaaggtagatttaattccatatctcctgcccatcagtttactccggagattgaagtgtggaagaactcagtgcaagtgtccagccgtttctgagagaattcatgctccaagtccagtttgggtccaggacagtgccttgctgacgaattctgttgaacttacacttgaaccttggcagacatggagggtgtctgccatttagcagctaaaaggaggggctctagaaacagaagggttgggctggaattcccaccctttgacttgcaaaccttatgtccctgggcaggttatgaaatctagctaggcttccaactcctcagtctaaaaatgggactcagtggtttctacacaggggcgtggggagcaaagaggtaagcgccgagcatggcagagctgtaatgactacattcaccagttaattagctgatgcagtaattatcgctgcatagcctaggcaagagttcaagggccaggatggactttgtctctgtagggtcactctgcaaggtcaaaggtgggtagtgtatgaagcagatactgggagagctaaggtggtccagcttccacagtcgtggagttgtctccaggaattgttgagacgagtcgtgaccactgcaagaagcagagggcctttgtgtccaaagccagaactctactcctgacttcgactccttgccaagcgtatgctactctgctttcccaagtgacttcagacagaaaaccagcacgaatgcagtgactgtggcaggctcagtggtgtcacagcgctcgctgtgctcagggtttcttgctggtgatctgaaagtggagtttcttcagaatgtgttcccagacggctatcattctctattcatgaaataatagtgttgagatgactggcaaggcagagtccaagttgaagagtcttgaacatgctgccctgggcggagcttgcagctttgattggatgtctgtctattgaagtagacgtctcggaggttcaggtagctcatagaactgcagaggtcggcgttagtgtgattgctcccccactcctgcactccggtatcaacaggttttcaaagggcagttacagaagtcattgctgatgttcccagatagaattttctggcccttggagaatggtgttcaaagggcactccagggcagcccagggcatggacttcagttggctgcatgagtttaagtcttatgaagtaagggaatataaaggtccttcggcatcttacttgacaagtcctgacatcttttatcagtactttctgtttagaaaagcatgccatttctttcacatttgggaaatacctaatagtgttcaacctgaaattattaattatcttatcaatataaacattgtgtgtgagatctgcaagtaatgtagaaacttcaaagatgttttcagaaaatgcctggcacatctgatggggcttaagttgtacagcaaatcatctcattgatttttcttattaatatgtagttttaaaactaggggttctgtcttacaaattttttttttcaaaattcaggagtgaaaattttcaactattgagaaataattacgtttagttttataatggcttaattaaggtcctggaatatatgggcagtgtcccattgttatatcaaaatacctaagattatcagtttgcaaggaggagacatttttgttctcacagttttggcttcagttgtacagtctatggattctgttgctttggaactacaatggcatagatggcaggtgtctgtgagcaggggacagagttggagcatgccaccagtgactcatcgcctgtccccaggtgtgtgtggtgtgtgtgtgtggtgtgtggtgtgtgtgtatatgtgtgtggtgtgtatgtgcgtgtggtgtgtgtgtgtgtgtggtgtgtggtgtgtgtgagtgtgtgtgtgtgtgtgtgtggcatgtgtatggtgtggtgtgtgtggtgtgtatgtgtgtgagtgtgtgtggtgtgtgtgtatggtgtgtgagtgtgtgtgtgtggtgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtgggtgtggtgtgtgtgtgtgtgtggtgggtggggttgtgtgtgtggtgtgtgtgtgtggtggtgtgtgtgttgtgtatgtgtgtgtggtgtgtatgtgtgtgtggtgtgtgtgtatatgtgtgtggtgtgtgtgtgtgtggtgtgtgtatggtgtggtgtgtgtggtgtgtatgtgtgtatgtgtgtgtggtgtgtgtgtatatgtgtgtggtgtgtgtatgtgtgtggtgtgtgtgtatggtatgtgtgtgtggtgtgtgagtgtgtgtgtgtggtgtgtggtgtgtgtgtggtgtgtatatgtgtgtgtggtgtgtgtgagtgtatgtgtgtggtgtgtatgtggtgtgtgagtgtgtgtgtgtggtgtgtggtgtggtgtgtgtgagtgtatgtgtgtggtgtgtgtgtggtgtgtgtgtatgggtgtgtgtgtgtgtgtgtgtgtgctgcacatgtggaggtcagaggctctgctggagattttgtcagtttagggcagatgacagtcacctagcaagaggcaatgtcagttgaggaattgcctctgtcagattgctctgtggacaagactgtagggcattttcttgattaataaagtccagcccactgtgggtggagtcagccccaggcaggtggtcctggggagcctaagagagcaggtcaagcaagccagggagagcaagccaccaaacacatttctctgtgacttctgcttcagttcccgcctccaggcctctgccttgaactcttgtgttgacttccctcgaggatggaccgtaacctgtaagccacataaacctaagtcgctttttggttagtgttttatcacagtatcagaaaagcaagctaagacagaggccttccaccttggccccctgcccagcagtgacaggagctaaggactacacccttaacacatgggcctttaggggacaaactgggacgattattattttgtaggttctttttattgtttgtttgtggttaactttttggaagtttttttttttttaaattagcttatgaagtcttcattatgctgttttctaaacatttttgtttgtttgtttctcttccccccgtcgccccctcccttgttcccttccattattttgacgccacacatgatcttttcatgcatgatttcaacgtgtagggctttatttagcttggggaaccagaagggtgtatgccccagccaagtaaaaatattttaacatcttttattattgtttgtgcatgggtattttgcctgcacgtgtgtctgtgtgtcacgtgtgcagtgcctgtggaggtcagaagaggccactgggttccgtagaactggagtcacagacggctgtgagctgctgtgtaggtgctgggaatcaaaccccagctcctgcaagagcaggccttgtctctggagcctcacaagggaagtcttagctaggtgattgtaattgttggagactctagggctgtgaagccagagcggaacaacagctgcttccctggctacatacgtgttgctgatcttcactcacaggcctttgtatcactcgcagagtagagactcctccatgggtttccttgctctcctgctccttgcgtccgtttctcaggcctgctgctaaccggtgcatgaccttgctcacaccatgtatctttttgtaagtcagcctcagtgtttttgccttggagaggatggatagcctccccttgaaggtatgaggcaatctagctccagagacaaatgaaagttttgtgaagtgaaaatgtatagggaacagctatatttccatatacacaattacaaattttcttcaaaggttaaggagctggtggagtgaactaggccagagttcaggttcagtaatcacgatggttacacgtgtttagccaaactcatatgttccactgtaatattccaaattccagggagtagctaaaagtgagccgtgcaagtctccgctttccatgttacctcttcagtctctggtacttgcagaagcctggtggcgctgccgattggaagcaggtgggctgtgatcagagctggctttataaagcacagatgttgatttacaaatgaattttgcctactcttaacattttatggcatgaataagctttaaaggctgttgtttggagtgtctgcagtgggtcttcactgtttttttgagttcaacacactcctcatggcagcactatgacaaaatgagtctcgtaagcttttcagggtgattaaacatagagttgtctctgtgagtgtgtgtgtgctggcatgagcgtcacagcacccgtgtggggctggagggcaacttttggattcagttcactcttcccttgtggttgggtcctgggagggaactcatcccaggatgtgagagctagtacttatgaaccatatcaccggcccttctgtgtggtttaaagacccttgagcatgtggctgcaaatatccatgtttcccagttttcctttgagtggtatttatactttggaaacagggttttctctgtgtatccctggctgtcctggaactcactctgtagaccaggctggcctcaaactcagagatccgcctgcctctgccttctgagtgctgggaataaaggcgtgtgccaccacacccagctgatgtttcttaatgtgtacctaagatctgtattatatacccttgtgttgacttgtggaaaaattaccttacatcctagatagtgtatatattttaaagaactgatttttttaaatgatgtatcctagagttagtttcctcattttgtttcttttctttttttctttttttaggcaagaagggactgagaatgcactgtgtagtttccaatgcagggcaattggtcctctggttttccttattttctattataagccctgctctccccatgttgatgccacagctcctagaagatacctatgtttctgactgcatccatagtcaggtgctttggaggtaggggctgagtagcatgaggtggtggggtgctcgggtggtagaaccagcttcaggttgtccttccttccctgcccactcacatggtttctgattaggaagtgaaaaggtgtgtgtgtgtgtgtgtgtgtgtgtgtgtgtgtgtgtgtgtgtgtgtctgtgtgtgtggtgtgtgtgtgtgtatgtctgtgagtgtggtgtgtgtgtgtgtgtgtgtgtgtgtgtgtgtgtatgactgcattaacacacatgtgcatttgtatgtgtgcatttcagccattgctgtcctaatgagaacctaaaatacatgaccagttatggacatagttggtagccacacattaagggcttagaaagctgcctggtgagcagtggttggcaatctgacttcagccagtcctagtagtctcttagagtgacaaaagccagttcaactggcatctctagtcacttgtttcgtcttcaatagtgggcatgtgtgagatgggtcacagtggttccagttctgatccgattcctctaggagtggacttgaaaatgcaggttatgttgttccaatcagggccccttgcatttctatttcttggtttaacttttctttgctgttgttttatttttaatgctgtagagatagggtctcaggctggtccctaactcaacagtgattctgctcaagagctgggatggaagcaggagacatcacatcctacatgatttttttttttttcctgtgaagcattcgggttttgctgtttttaataggtgtaggtttgattcatttctttttacattttttacttaactgttattcccattataattttaaaagttgtttgatggggaaagtccttctgtgtatgtttatcttattggttgtaaaataaagcactgttggccaataaggaagcaagataggtgggactaggagtccaggaggattctgggaaacgtagtaaagagaagtcttgtgatcctggcaggaagtgacatagcaggcagactctgaatataagcagggacaagcaggaaatcactctctttctcccccctcttctttgtggagtcgccatgtgatccccagcaagagagggcacatatggccggtgtcctcgataagatgcctttataaaatatatagattaataattatggttgataattaagactgagttagcaagtaagaaatcctagttattggccagcaacattgtacctaatataagactctgtgttattttgggcgcccacatgttggcgggactcgggcagctggcggaaagatttatcgttacagttgttcccttaacaggactgcaagtggtaggctttgttcttccctacaaatatgcagatagcctggcttttctcaatacacctttaaaattgacaacaacttcatatttatttatttaatatgtatatgtgagcacctatatgtgtgtgtgtgtgtgtgtgtgtgtgtgtgtgcgcgtgtgtgcgtgcgtaccatgtgcatgcctgatgccactagagaccggaagaaggtatcagatctccagggactggagtttcagatggttgtgagctgccatgtgggtgttggcagctgaacctggatcctctggaagagcacccagtgctctaaccactgggaaatctctccagccctggatgctgtctcaaacccagaggtccctggtgactcacacacagcttccagactctcgctcgcatcagcagctcagtaggtaaattgccatgctgtctcacatgcccagcacctggtggagagagacaagatcagaggcttattattgaggtctgaggaactgcagctcttcccacggttgctccctttggactgttcctgtgtgactagtgaggaaacaacagagaggatgcagacggaagactatggacctaaactcaacacactccatcacagatgcagggcatgcatcataggcagatgtaaagacgaagccatggattaatatgacaggtttacatggcaaacaataactgtacatttcacttaattaataagtaatgcatttgggggggacagggtccatacagtatctaaggattctttagtttcttttttttttaattttatttattatgtatacagtcttctgcccgcatgccagcagaggcaccagatctcattacagatggttgtgagccaccatgtggttgccggaaattgaactcaggacctctggaagaacagtcagtgctcttaaccgctgagccatctctccagcccgattctttagtttcttattactcttcatgaacagtgcttactttgaaaaatacaaacattttcccagtcacagtcaatggaggaaaacctcaaattaggcaacacagcacagctatggttattatttaagcatggatcctagttgctatttatgtttttaaagtgtagcatggtaaacatttgtctgagcagacgtgctgaacggttatgatgcctgacttattttgttaaagcgactgtgcaatctgccttattttcgatgtacttctgcaggtaagacacacacgtgtgggcatggatcatcggttgtgtcagtaatcctcatactaagcacgggtctcctgttgactggaccagtgtctaccgcctcagtttgtgacagtgccttattggcacgtgactgagataatccaggagcgttttagttgactattttcgacatggaggagtgaacactatccaaattataatcaataaatggttaagaatagctgtagaacattactcatccacagatcttcaatcttgaattgaggatgagttaaaatagcaggctgttgagaatcaaagaaaatctttaatgataaaactggaaatatgctgtcacgaacccagttcatgtgactgtcctcagaaagtacttaacgctgaaatgtcctatggattagctgattggcttcattcattcattagttgtcattgagcctttatgacaggctgggctttcatactgaagacagagtgtaaatccttttgttaaaagctggcttccctttgagaacttgtagtttgacatttggtggggatctgtggggacataaacacacccaacacctttgctctcaggactagaaaccaacaggcacttttgtgtcttttgaatcctttcatttccagtatcagagaatttctgagacagagcgaggactctaggaagcccctagaggtgtttcatgaatagccgtggacggattcagtaatgggcagaggagatgggataagaagagccctgtcaaatgtcaggtgaaggttagaaactatgtcacaggggcttggaagagccacatttcttcctgtcccgagggtctgacctggttgaaggggcttcaaggaggaggtacaatgtgagctcaactcagcatggatggacctctgtgtcattgtgacacccatggtcactggcacgttctcgacattgtcttggtataccattgtgacacccatggtcaatggcacgttctcgacattgtcttggtatacttttcagaagtcagcaaaaattcgttcttcactttagtagctctcaaagtcccaaagcaaatattttgatgttgttgaggccagcagagattgaggaacaatttgaaaacgtttttcatgcttcacccgatagggagatttgagcttggtttagaccccctgcaactgtcatgacatcttccagacactgaagcatgtgttgggtttacagagatccatggcaatgacactgggacctgggagcctagtcaggaaggaaggaaggaaggaaggaaggaaggaaggaaggaaggaagaaaggaaggatctggagtgtctttagacagtgcacccactccatgaattccaggcttctactcagttctccgggtctccaaccccagggttgtatagtggttgttttctctataaattgcctcctattgattgtctccagcttccctgggagctttgggaaaagaattttcatctaaaatgatggttttgttttgttttaaggtagagtctcatgctgtgtagttggggctgggctggaatgcaaaacgtggtgaaggctggccttaaacttggagcaatcctcctgagtgctggaattataggcatgtactaccacacctgacttaaagtccccctgcccctctcattcctgattcttggttttgctactgtaaagagcaatgaagatcacggattcacatgagcacaggggagggcgagggaagtcgacagggtgtaatctaagctcctatctaaattcttagaattcagacactcgttactgaggtcctatctgaagtaagatgtttgtcactgttaaaatatcagaaaaaaattctttctgtgctgattatcaagctcgggacttttattacgtacagtcattgttaatggacagtggagccccagagaagtccccagcagagcccctgcggctactttcagggatcagccagagctttccctgcacagtatctcctgctgaaaagtgcacatggatcctcagggctcaacataaaggccaaagggccaaataataagcagatatagcaaaagactggaaccttaaactaccctgaaggttgttcattgcctggataaactggcagattgaagtgtctaatttcccaaggtttctgagagggagatggcgtccaattcctgttccatccatatttaattaagccatttgtgaaccttgcagtgagttgtcttggtaacctcatgtaacagtttatggataccccttgtgcccggctctcactgtctgatcttaaaagacctgaaggaatttgtctatcacactgctctcacgctacccactggatgaagctggaacattgaatgactggctgagttaggctctttgttggcaataaacagaaaccatccctggccagctcaagagcaggaaatgcccccaaggacattgaagaatctcaaggcaattgaaaggagggttcccagtgagccatagagaggtgagaagcatggccacagggctctgaacagggagggggaatctcctcactgaatagcatcatgaatttgcatggggtccagcagttatgtatcccctgtctttcatgttaattgttttagattatggactagtagaattatttggattaggtaggagtcattacttgtggtggtttatcttggttgtcaacttgacacacctgagaagattaattaaagaattgtcaccatcggattggcttgtgggcatgatgatgggggctgtaaaataattaatgatagatataagaatgcccagcccactgtgggctaagccatctctaggcaggtgggctgggcctgtatatcaataaagccgagccaggagcctggtttctgcttcaagcatctccttgagttcctactctaacttcccttgatggtgggctgtaacctttttttttttttttgatttttttccattcatttatttagctcatacataaagtcatgcacaattatgatacataatacagtgtgttcacaatggcatggctaaattaaaccaattaacatgttatatcacacatactcatttttgttttgagaacacttatactatctcacaacttttaaaatatagcatattgttatcaaccatatttatcatgctctcagtagacctcaagactccacagagtccatgcctcttgtccaactgcagttttatatcctttttttttttttttttttttttttcccgtgacagggtttctctgtgtagctttggagcctatcctggcactcgctctggagaccaggctggcctcgaattcacagagatccacctgcctctgcctcccgagtgctgggattaaaggcatgcaccactaacgcccggctgtaattttatatccttaaaccaatcatttccccattgctaaaagacccacattgaagcctaatagccacaattctgctctctgttggtgggctgtaaccttaaactcaagcaaactcttccctccccaagctgattttggtcatggcattacaacaacagaaaaagctacctggaacattacatgcccgggaaggcagtggcactgcccagatccggctagtatcaccgagctaagctgggctttctgctactcctggggcagtgtagcatgggccatggcaggaaaggccatggccttcgtgaaatgccacaacttgcaggcaaggaaagctgtagtaaacatgtaggccctttgaagtaaattatgatatagtacatatactatatactatattgcttgatatcttggctgccttaagtgtgtgatcagctcaggggcagtgagtatatccaggcagccagggcttctatatgtcagagactccgtcccgtctgcatcctctttgcctttcttggtaacttctgaactcctttctatctctaggaatttgcttattcaaggtgcctcttgaagacaggttgcgtaataaccctttggtgactggcttattttatgtcataatgtcaccaaagaacaaaggtgagttacattgggatgtatgtactttaaggcagctaagtgtctatcaagaccaacttcttcctggggggaaagtatcagtgtaattgttcttacgaagtctttgagatccacagacagaatttagagtaggggagttctcacagtaactggtgccatcccatcttgctgttagaggtctttaaaatccagccgtggcaaacttacatcagaaaaagtaatgcatgcgacctttctttggtggtttgtagctgccgccacagtgaacgaaagttgatcccttcccagttcagttttgtccctataagcttgaagagtgaatttgtaagcacctcccagtctatttcttagctgagattagccctttgtcttagtggataatgaagaattctcctaggacagattgttttgctctaactcgtccagaaagaacttcctgataccaaactcagagaacagttcaggtgttaacatgcaactttagaaaaaaaaaatagcaggatgtgtttcactttgtaacctttatttttaatattcaagaataaatgttgaatgagaggcgtttaaatatttcaatttaaagagacaaatagctgttttttttttctttctgattttgattatatccattgatgtgtttggcccatgtgtaagaatttgaagctccctagcactgtattgactcatgttcttgaagcctcttgagtttaatacacagactaattattacatacatgtaaaatagggatgaaaggaagaaaatgtggatatgtacaaaccaaaaaaatttgataactaaagcaatattatttaattgcctagttctagcatgcgatgatcttctatgagagatatttaaaaacgtcttaatattagaaatttaagtttgacttgccagatgtggtggcacatgcctttaatcccagcacttgggaagcagagacaggaggatctctgtgagttcgaggccagtctggtctccacagcgagtgccaggacagccagggctacacagagaaaacccggtcttgaaaaaccaaaaccaaaaccaaaaccaaaaaaaaaaaaaaaaaagttgcactttgtaaacataacttaaaaaaaaaaaatcagctgtccaggtccccaccacaaagcattaatccaaataagttaatgatttagcaacaggtctgttgtgtttagagagcgttcaaggtcattgttaatatcagggacatgaccacttaaacatttgtactacaggctttttttttttttttttttttggctttggctttggctttggctttggctttggctgtgttttctaagagcaggaaaggtagtggaagggattggattcttaggatgctctgccttgacttgggatgacagacccgtaagagacattcattttaagtcaaaccaagagtcaaagctctctatgaaaaccgggctaatgagcaagggcttttatttgcctctttctctgtttacctgtcagtcatgcctggaacacttgtgagtccttgctttgtgttggagagacgggaagagcttgcctccagccgtgttggaagcatagagagttttctgctggttagaggctcagaatcagcatctgtttaggtcaagtgttgtagaggaaatttgtcaggcggtaatttcttaggcggtgaacacccaggaggttagttcataaccgcactctgaagaatggatcatgtcctaggcttgctcctcagcagtggaaaaaataaaaagacaataagaagagcttagcatctctccgagatatcttcttcaaagcaggggttataataggcatctttattttagttatttaaaatatttgtgtgtgtgctcctgcatgcacgcattgcattggaggccagtcatgaccctcaagtgtgctgtccaccttgtctctggaacctggggcaattaaatagtactgctttagttttcaaattgttttgtagtttgtacatactcagattttctttctggctgactttgaactcaggtcctgatgcttgtgtgacaggagctatttctccagccgtattctaagaaattctaaagaaataccaacagcctcgtgtaattggaaatctatgtaacaaaatgcatgttaatgtcagacccatctggttattcctacaaaatcttttttccccattttcttactagcagaggacttacatttgtgggtggtcaggataaagaacacattccctccactccctttccctccccccaccctccctctactcctcttttccaccacagactatgtttcagaggaagaggatgccctttgaggaaggtttagcgcctcactctgaaaaggtgtttgcagcatgagcgtgggaagaaagcatcttgggccacagagatgaggccactgtagctgccctgcagacgttaccaaggctccaagaaaggaacctgctctccagatggccttaagtctgcctctgctgttttcacctaagaaaaggtggcacatagtgggtggtcaagggccagagtgcgtttcctagatcatctgtagacggatttgtaagcaggagagggaaacagttgctttagaacagtcagggtttgctctagaatagttgggtttggtctagtggctgagaaggaggacaggagaagagagagagagagagagagagagagagagagagagagtctgaaccaagcttcttgccacagaggcactgaagggacacagcctttgctctgtttcactttagatctaggaaaaacttgggaatttggacacccaccactgctgctgaggctctggtaccctgaaaactaaacatacagatttgagtgaggtttttatttgctcacatctagataaaagtgtcatcagttctcacttgactccatgttttccgtgttctgtgctattgcgctcactcaggtagaatgtctgattttcttttcagttgcatgaacatcctccacaggatgttccccatgcattccccactgcctggtcagtttccgttcttacctgcctgcctgtcatctgctcctcattcaaatgtcagcggtgacttgtttctgatctccagactgtgtgaggacagtgtattgcagtggtggttttaattttcattgtttttttgtttttccttttctggtgtggtgtatgaatgtatacatgttcgtgtgtgtgtgtgtgtgtgtgtgtgtgtgtgtgtgatgtgtgtgtgtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtggtgtgtgtgtgtgtgtgtgtgtgtgtgtgtgtgtgtgtgtgtgtgtttcctttgcgttgaggccagaggtagatgtcaagtgtatttcctaagtatctttccctcttggtttttgagactgagtcagtctctcactgcgtctggagcttggtgattggctgctagaccagctgcccattgaattccaggcatcctcctgcctcttccacctcctcagtgctgggattaccgtccccagtttgctggccacctggatttttatatggcttccaaatattgaagctcaggtcctcatgcttgcatggcaagcactctccctgctgagccgtcttcctagcccttgattctatttctgtgagtattgggttgtcctttttctccttttagatttaaacaaaagggcggagtctacattaggtttgtttgtagttaccttgccggggtcttgccaagcatccatcggatagaacacatccaagaaatacattgtatcaatgccctgtgctgtagcagatgatctggacttcttctgccttagacaagtctggtttcaaattgtgcctctacttacttttctcacagtgtgatcctcagatgttatttaaccctgacacctagattttccttatctgtaaaatgggatgctagtcctgtaaggaggtcagtatctcaccttactaaggggttcagctatgatcaacacttgtaaaacaggcctatagcaccaggcacctgagcagtgaaataagtgcacgctgtcttttagtctttgtaagatcatttgcaggaatccctctgcagcggctgacctgagctcacactccaggggtgctggaagtagtgccatattgtgagctgatgtttgcttagctgttcaaagtcacgctgccttatcaattgtttgttttggttttgatcttttttttttttcttccttatgctgccagtgtacatttctaaattgccagtgcttgggtttatctttctgttctggtttgatgcatattatcctctgatgtactggaaagcacctggatgtatgagtgtgaataataacttcgcttatggtgtgtacacggtcatatgctcacttctccaccctgtatttcctatggctagaactttcaagttttgttacattttaacgctaaggatttttgcttgctaatattttccccctaccagaatatagtaacaaaaggaaacattttaaatgtattgctttatccttttattgtgtgtctaggtgtgtgggcatagcacgtgtgtagaggtcagatgacaacttggtggattcatttttctctttctacctctgtgtgggttttaggcttgaactttggcaggcagactttcacaacaagtgcttttactcactgagccatctggctggctcctgttttgttttatttattgagacaaaatgcacttgtttgcagccattacgttaaaaaaatcaccccccccaccctcccggtatctctgagctttcagcttggccaagaattgggaattctgatcaaacttctgctactgttagggatgagcaaaagcatttatttatataagataattagccagtttacaaacatatttatttaggaaaaagtgggtcaagttttaaatagcaactaatcaaattataatatttcccttggaaacacttgtgaatatcaaacaaaatttgagaggattttactcctgtctcttagagctacccaaccagcaaatgtcactcaggctttggcagtggttggggaaatgctttaaaggggccagaggatgtagctagtctgtgtggagtatttactgagtgtgcacaaaggcctggggttgatccccatgcaagatgcaaaccaggtgtggtgcctgtttgtggtcccactcaggaggctcaagcaggaggatcagaagttcaaggtcatgctttcaccgagtctcaaatagcccagggtatgtagggagtttgaggccagcctgagctacttgagacccggtaagagcattttgtaaaatcttgctcgaaaacttctctgtgagcagctttccattggctcacgtctcacatttcttatgggcctctgaagcagaagggctgctggtaggcgcgcccaagattaactggtggtaagattgggtttgaaaactgccacactctcaggcatggcaaaggatgaatatatctgaagacgctaattttattagtcacatatgatttggggcacaagaataagaaaatcccagtcaaatttcctggcttgacatctgtttgtccactctggaatctcctgacctggagactgcaggcaggtggactggcccccagtggaccaagcaactgcaagtccgctcacatcattatgctagtctcactcccacccaccaggagagggagtgcctcagacccacctggacccactgggagacccatcagagtactggactgaaaggattttgtggtgagagtaacagtaagtgtgcatccaaactcagggcccctggccactgtaccgcaggtgttagcctcattccagtcaggtactctgtctatggccacctgggggtgctggtagcttcctccttcctcctcttctttctcccagaagtgatgagtgcctgaagccctagaatcagtacatacacggtacagtcacaaagcgaccgatgctgcagtggcttaggcagagttgaaatttttttagctgacattgaggctggaggatgagcttcgggggcaacaaacgggatgtggtcagcaccagagtgggagaagagctcttctccatcctacagtcagggctggtggcaggaaggcgggactctggggttgagcaagctgtggtaacctcacacccactgtggccagtgccttagcccccagccctcagaaggctgagttctctaggtccttaggaaactctgcagccaccaattactcagttctcagagttctctttcaggtcactgcccctgggctctgttttagacctgctttaggggcggtctcctgatggggagtggtccgatactgacttctcagcccctgggaagcctcagtcttcagagctctgctttgtctccagccagtgaagaaaggttttcagggactctgctggagggtgcagagggaacccagtggtttgctgtggtcagtgatgttgacacctcactgttaaagtggaaagagttcgagaaacagcgtttttctaaaagcttattgttcatgcagcatttaattctctctcatttgtgtgtgtgtgctcgagtgtgtgtgtgtgttctagtgtgtgtgtgtgtatgtgcatgtgtgtgtgtatgtgcttacctgtgctatgaaacatggactggtcactttgcctatgtctttcttccctttctttgcagctcatcatagtaacggaaagctcttccctgcctgtctaaaatctaaattccacgagtgtggcagtgtgtgctgtcccatggccagccccttggcagaagcctaagtgttgacagaaaccttgcctaagttttctttagcagatttggaacttaaaaaaaactatctattttttttttgaggatttcatacacgggtgctatattgacataatttttacctttccctctccctactcccatgtccctctcaaggtcatgacctcttcttttttaattagtcttggaactttgagacagtgaccggaagcttctgcaggaaacgctctgtgtcccctcacttgaggttgcattccctgaatttctgggtgcctagatttagacacagtgtgattttctttttggtgttctctgattcctgggctttgaagacacagctgggccagtttatgttttggtttagtatttatttattttactttatttttaacaaccagtgaagtttaaggctgtacccatttcctctctttatttcttgctttaaatgggggaaataaagaagacctgagtgttgccccatgtgctgtgattgtagtgtagtttgaaaataaccacctaaaacaagctatttagttttgtagctagaggctggagaggtggctcagcggttaagagctcaggctgtttttgtagagcacctaggttcattttccagctcccacacggcagctcgcagccacctgtaactccagtctaggtatccattgccttcttctggcctcctggcacatacgtgttacataaacatatatgcaggcaagcaatcatacacctaaaataaaaataagtaaaattttaatttttagagagccaattatttctgctttccaaatatatccccgtatcaataaacacaatgtaaaatcaaggacttaagggctgaagagatgtctcagcaggggctgggcagtggtggcacaggcacaccttttttccagcactggggaggcagaggcaggcagatgtctgtgagtttgaggtcagtctggtctacagagggagttccaggacaactggggctgttgcacagagaaaccatgtctcaaaaagctaaaaaaataaagtgcttgttgtgctcgttactcttgtagaggacctgggtttgttggttcctccttatgccaggcagctcacaactgtctttaactccagttccaggggatctcatgcccctctggcctccacaggactgcaggctcatggtgcacattccaagcagacaaagactcacatctgtataaaaacccatttagaaaattaacaagacaaagtgctgggtggccaggtatacttaaaataaagcaggtaagtgagggcatgtgatgtcactaacttaactttgaagggtggaacactaggagagaagacacgggtctctcataactgttactctctggctgatccagaagaaaactagtaaaggacagggacttctgttggtgacactgagtccagagtgagcttggacaccatggccccttcacaggccttcctcagacaggagcagaggaaggattcgaaggagtcttatccttcatgctaatctctgtgcctcctggagggagaggccaccagcttccacggttgtggcctttcagtgacaatgtccttagtgtgcaatttacagacccacggttgaaggcttgtctgtctcctactgtgtgtattttctcatctaatttataatgatggatgacattgatggatggcatggtgacttaatgctcaaagctaaaacagcgtaaatgaggaaggctggaagttttggtttagcagagaggttgactcttgtgaatctgcttgttcctggtaagtgcctgtgagatgtggtgactgtggaaggctgtcccttttttaattagaattttggtgggaaatcttcacaacgataaggccaatgaaccttaaaagcagcatttaaattaaaatctaaaaaatccattgaagggaaaggaatgcgaggggttggggagatggctcagtggtaaagcgcctactgtgcgggcgtgaggacccttgttagagctgggcatggcaagagtctgtaagcttagcgttgatgtgagtggatgttgcagatggagacgggcagatcccagggctggatggcagctagtctaacctaatctgtgaacttcagctccagtgagagagcctgtctcaaaaacacagtggggcgcgttggaggaagacatgggggcttccacacttgcaggcacaggccatatgcatgtgtaatcctaccccaccttcaggaaatatgaaagccagataaagtgatacacacatataatatttagttatggagcacaaatggtctcaagggatggcgatttctcctcacatccacagggagtagaagattattctatcttggagagaattaggaaaaccctactgtgctgtgggctggtagtcctgggttctgtaagaaagcaagatcctgagcaagccatggggagcagggcagaaggcagcactcctccatgacctctgcatcagctcctgcctccaggagtctgtacgcactcgtgtgcaagtgtgtgtgtgtgtgtgtgtgtgtgtgtgtgtgtgtgtgtgtgcttgtccttacttccttcagtgaggatcagtgatgtggaaatgtaaggtaaacaaaccctttcctctccaggtggctttggtcatggtgttttcatcacaacaatgatgaccctaaaactaagacacttaccaaattcaaatactgctgttcctaggaagacagactccccgtaaagaagagtgaaggtctggtgcttgcatgtatcagtgagttaactggtaagattgaaagtcgttactctgtaccttagattcctggaacttcactttcaggtggtggaagcatcagttggctctgaaagtgaatttgccttcaggagcttcgaagtaggaggcccccaggaagggccttagaatctgtgtttccccgaggctgttttgaaaagaagggaaagtggcgcttcctgttttctttcttaaccagaggaatctgtttggtgtcagcacagaaggaaagtactttatagatgaaaggagcaagtgtggccgagacagctgctccctacagggataggacagttgtggctcttaggcccgagggacaacggtgcttcccttcaccttgtcttcctaaaactctcgttctcagatgtgaaattctaaaagtgaggtatacaacttccaaaaagcctttatcatggccagtcctgggccctctagagttctcaactctttccttgctccacgttgtctcttaagttgtgttaaattacaacgtgaagctggatttggcagtgcagcctgtaatcccagcccttgggaggcggaggcaggaggatcaggagttcaaggtcagcctagcctgagctgcataagacctgtcttaactcccctccccacataaacaaacaaaaaagaaatacatatgtttgcatctaaaactaagaaatgcatatgttcatatatattatgtggggtatggaggctttgaaatagagagagaagaaaagcacacatagtctatctacagatggttgcagtgagcttcagaccacaaagatcttctaggaagataatggtgtagctcctcctttccttcatctttagacacgcatgtgtgctcgggaggggttctgctttgtcctctctgtcctctcccccgaagggctgatattggagacactcttccacgtatgaagggttaaggacagccagctctgagttgttagttttattttcagaggaaaaacccaatgaaagtagccagttctgtgatgtgttgtaacagagcagtgttgcagtgttttgcctgtggaatggaggaggcccctctttgcccttcaccgaggtcaaaagattagatttgtgttaagaattgcaaaacttcaaaaaaaaaaattcaagccttattgacctcaaggtatgctcatgctcatgaccatgggtggacccagaagtcgggacagggcttggctcataagcaatacttgagataatttttgttttgtttttttgagacagtgtctgatgtaagtatgggagctcagattgtcataggttggcctcattatggatgttggccttgaactcctgatcaccctgccttcacctcctggggcaggcggcccatcctgctaggcttggctttaggaatggtttaatgcctttgattcttcccacgtcaatcggaggtgcgtctttgggatgacagcttctttttgatcacctgtgtttacatttagctattggaaaatgctggaagcttggtgtctgcgtgagtcacacgagggtgggaagtgtcttgcttctcagctcgtccctttctggcagttcctaggcgcaccctggtcttggactgactcagaaaaaacactcagctgctttagctttaacgaggtagcttccacccatccagctttctggaaatgcacagcttcttgagctgtaatcatgactgtgggaatcactctgcagttgtcagaggtttttctggccagggaacttctcttgccaactttttcctctaagaatatctcccttttatgtctgctcagtcaggaagagatacctgcatctcatgttcttcgctgttttgaagaaggcagcgtggttaagggaacgggaggggtaggtgcttagctccagacctagtcaccaaccacagtgctctgaagattttataggatggaaagttcctggttacttaacacttggccctgttctgtcctggcactcttcctggctgggtgattttggaggtccccttatgtcgtctctgtgtacaatatatgatgtcaaacatatggttttcccaggggtgagtcagtgtgaatctctatatcgttggtcccttgttttaacctttcttcctgtggtgtcatcaaccccatttcatcttctgcgttttgttttctttgcctttgtgagccactgaactatcggttcctaaactcagacttctgctgtcccgaggcagtgagaggtttggtgcaataaggtagcagcttgaagagcaccacagccagacagcagtgtgcatctcaggtgtggttgggtcatctgttaagttttatgtatttatagagacttatgcattacaatgttttataagccaagtcattctaatgtaagttacatatgggaattggtgttcaacaaggcaataaaatgtgtaaaataatttcagtaaacagtatttcatacccagtctgacaacagtgaggtttttcagaacctatacacttgtcttagattaagtttataggtttgcatatgtgctggctagttttatgttaccattggagaggaggaagcctcaactgagaaaaagcctctgtaagattgggttgtaggcaagcctgtagggaaatgtcaggaactcgtcggattgggtggtaggcggttaggctttgctcccttttgacacaatccaacatcccattgctaagaaagcaccatctaaagaccacacaggcgtttgtgtgcctggcagctcgtgtcaaccgtggcagtagctagcatgagggaagtgcacagatttgtatatataatcaatatacatggattgtatctctacatatgcaccgtactgcttgaccacctcctcccccatgggaatctgatctcagagaagaaaacatctgatggcctaagaagcagattcttttggtgattaaatgaccaggaaccaaagtttcatgctgtttgggtttctagtcaaagtgaatgcgatctcgatgcattggggagattctggttaataccggaatgaaaaaggatgacaaggacagctaccaccgggacacctccttttgggaggattatcatgtgtgtatctaactcacacaccctcatagtatttatggcagcactgccggccagaccccctgtagctctgcctgtgcgaggtcaggtcctgaatctgagtgagatttcccccgtgagaagaaggtgcacagtctttccctcttagaattgtcctagaaacattcgttaaaatgttccataggttcaaagtgtaattttgtaactcacgaaggaagtttttatttgtttggtgttttgagatagtgtttccctgtgtagatttggagcctgtcctggatctagctcttgtagaccaggctggtctcgaactcatagagatccgcctgcctctgcctccctagtgcctggattaaaggcgtgtgccaccaccgcccagccaggaagggatttattaacttaggtggctctctcgaatgcctgctgtgcgccaggctcctttctgaagcagagcaagcattagtgactgaaactgacaatgtgtctctaagggtttagaacgtgtcagaagtggtggctgaaggtggtcaatcctctgatcactgccaccaggtagggagtctcaccttttacagagtcacataaaaaaaaaatgagagggaaataaaagctgacactaacctgactgcttttattttttcttttggagacagggtctcattatgtagctctggctgtactggaattccctatgtagaccaggctggcctcaaactcacagagatccacctgcctctgcctccgagtgctgggattaaaggtgtgcgctatacacctggcccctgaccactcagtattttgctgtgtctcactgaaaaattttcattttatgtgtacgtgtgtactccagagtgtgtacactgtgcatgtgtgtgcaggagccggagtgtgccagaagaagcgtcaaatcagacataactggaactggagtcccagttgtgagccaccatgagggagctggggaccaaatctgggttctcttcaagagcagtcagagctttcagccactgggccatctcttcagccctcggtttctattgtgcatatctagaggtgtgtgtacgtgtactattaaattacttattctctggcaatttcagacacaaatacagatgtcacctcttcatcctcctattacccacagagtcgattagtcctgcccactaattgtgcaagagtgtggggccatctactccagcctgggcagactgctggggccacacctctgaggaaaagtgactctggtctctcagctgctatcacctgctaaaagctcttcagttaagggtggggccttgtgagcccctcccttctccatacttggaggaataatggctgacttgatctcaggcgagttattttaatatatgcatatatgtatacatacgtgctggcgaaaacatgcaggcgcacacgcgcgcacacacacacacacaagcttgctgattggtccatgcttatttttacaacatcctataggtcagggcatttcacttgcagggctttagatagctcagctgctgttggtggctgtcaaggtcaaagctgatctaacaggtttcctaccacttaatgcttcctgttcttcccacaaccagatcttttcatgaatctaggactctcaaagtttctgagtattccaactgtaaatatttacccgatgtccttgtgcagagtgaggtttctgagtgtgatgacgctaacagtgtaaacattctttccctctaggttggtggatgaccgctgtgtggtacacccagaggcaggggatcttaccaacccccccaagaagttcagaggtaagaaaagaattgagaaggagtgacttaagagggtagattattttttgtcgttaggtaaataatgttaaatggtactgagtgtgtcattcccagttcccccacagggttttgttgttgttgaactttgggggatcgctgatcaacaattatctgagttttgttttgcaatgtcacttttacacactgataagaaaccttggcggccgggcgttggtggttcatgcactcgggaggcagaggcaggcagatctctgtgagttcgaggccagcctggtctccagagcgagtgccaggataggctccaaagctacacagagaaaccctggctgaaaaaaccaaaaaaaaaaaaaaaaaaagaaaaagaaaagaaaaagaaaaaagaaagaaagacacctttaatcctaggcatgaaagatggcttttcaagccattcagtaagaactaaaggctacccatttacagatttctgtggcagtcatattacaaaagttatgatattttactggcagcttgttaattgtcttcatgaaagtcctgtgctgcatgaatgtggctttcagagtcacaccttgaggctttgtggtaactaactgttgtcatagagcttcgttccaagtgaactcttagaagtctcttcatggtctccttggctgagaaaccagttgcagcagcctgttgtttagaactcagctgctgcaaaaggattaatgggatctgcagaacattctagaaaacagaaactagtcattaaaaacatcataacaacatgcaaacattaaaagctataagagagaacttgtgatactgatctttctgagctggagtgcctcacttaatacatgtgttagttaggtttcctctttttctccctccctccttccctctttctttctttctttctttctttctttctttctttctttctttctttctttttctctctctctcctccctcccctttctctccttttctttctctctctctctctctccctcccccttccttccttccttccttccttccttccttttcaagacaaggtttctctgggtaaccaccctggctattctggcactcactctgtagaccaggctggctttgcaccaccacctgccaggctttggggagaaagggtcatattagctcacaactcttggttacactcaatcactgaaggattcagggctgggattcgaaacagaagctgatgctgaggccatggagaggtgctgcttgctccccgtggcttgctcaacctgcttttttatacaacccaggcccagctgcccaggactagcgctgctcacagtgggctggcccctcccacatcaactactaataaagataatgctcctttacaggccagtctgatggagacattttttttctcaattgtggttctctcttcccagataactgtagcttgtgtcaagtttacaaaaaacaaaacaaaaacaatgcccccaaacccaaccaggagaatataataatgtctagatccacccatttccctacaagtttcataatttcatttttgtttacaactgagtaaaattccacggtgtatatatgccgaatctcatcatccgttcatctgttgatgggtacccagactgttccatttatcagctattgtgaacacaccagcaataaacatggatgtgtacatttctctgttgtagctatagagtcctctgaacataaaatcgggagtggacagctgcacctcatggtagctttatttttattttagaaatccccatattgatttcctaatggctatacaagtttatcctcctcccagcagagaacaaggattcctctttccccaattttctcttttacaaaacttactttgttgtgtgaatgcatgcacatatgtgctcctgagtgtgccagtatgtgtcacatgtgtgctgtgcccacagagaccagaagaggtgttagatctgtggttacaggtggttctgagctgccccatgtgggtgctgggaattgaaccgagtcctttgcaagaaccgtaaatgcttttaaccactgagccatctccctagccttgccattttatttgttcttttttttttttgatcatagccattttgactcctatgagatagaatcttaaagtttccatttgcattttccttgcattggccaagtatgtcgaacgtaaaatgtttatttgtataatgatagtttgtgtttctttttttgggaactatttatttcaccagtccatttattgatggtaagttttgtttcattctctgttgtggtgatagattacttattatttactaaagcttgcatgaagattcagaaagcaaagtcagccacaagctatagagatcagatagtggggatacacacctttaatcccagcagccagaagctaggaggtggtggtacacacctttaatcctaggagtcaggattaagaggtagttgatctttgtgagtccaaggccacccagatctacacaagagtgatcccagtcctaaagagaaacagctcacaagaagatgatctcagcacctgggatcacacacctttaatcccatcactagaggggtataaaagatgggagcagggtcttcagtagtcagtatcaggcagtcattctccagccacactgaggataggaagatactgaagtcttaggattctctagccacgccgaggagaggttacagtctgcggtttggtggagccaggattgcatttcagtctgaggtagagtaagagctagtggctggctgctttgcttttctgatcttcagcttgaagtttgaaccctaatatcaatctctgggacttttactttttgtgctatactctgtgtgattgaatcttagggttactattactgtgatgaaacaccatgaccaaaagcaagctggggaagaagtttattttgcttacacttccacaaggtagttcattgttgaaggaagctagaacaggaactcaaacagggcaggaacctggaggcaggagctgatgcagaggccatgaagggagttgcttactggctcagcctgattttttatggaacacaggaccaccagcccagggatggcatcacccacaatgggctggtccctcctctatcaatcactaataccctacaggcttgcctacagccccatcttatggaagcattttcttccccccccccacctttttcaaaatttaaattagaaacaagcttgttttacatgtcaatcccagttccctccccctcccctcctcccctgccccccactaacccccatcccatcccttttctgctccccagggagggtgaggccttccataggagatcttcaaagtctgtcatataatttggagcaggacctaggccctcccccgtgtgtctaggctgagagagtgttcctctatttggagaggactctcaaagtccattcctgtactagggataaatactgatccactaccagagatcccatagattaaccagaccttcaaactgccatcctcgttcagggggtttggaacagtcccatgctggtttcccagctatcagtctggggttcatgaacaaccccttgttcaggtcagctgtttctgtgggtttctccagtctggtcttgacccctatgctcatcactcctccctctctgcaactggattccagggtttcagctcaatagttagctgtgggtgtctgcttctgggtcctctgtgatgatcctagcttgtatcaagttgacataaaactagccagcacacagttgtttatatatgctaacttccctgtctggggtatggctggtacagagtgtgcttcattctgcccattcattctgacgatggatgtctttgctgttcgaaactttaacttttcatagttccatttttccgaccttacaccgtctcatgatggttcaaagagaatagtctaaaaggcaaactgggacaaggcagtgtttgtaatagggagaggcatggatgtcagggtttaaccgcactgtctgagagctgtgtcatctaaagtgggtcacctgtcaggggcctctgagggcatctgtcactgtcccttgagagttgagctgaatagcaagaacaatgctcattgctcagggtttgcaggctcttcagtcttcccagggacagccattgcagatgaagttacattatacaaatgtataataaaaaggcataatgcatttccatcaagtgtgtttggctctatccctttacaccctaccctcttctggggcagagttttctttcattttatttttgtttctcagtcattgaattttacccatagaagatcctccccccccccaaaaaaaaacaacccagccattggatgctgtgggctgagacatccaagctctctctgggatcgtgtgatcaaacttggttcccaggggtgtcccaggtctcctgctgtgagtctcagcagccggattcccagggggattttgtgcccctcagcaggttgtgtgccagtgcagcttattctgttgaatgggaaaggttgaagctaacagctctgtgcccaagaagcaaacagattcagatgcctgggcccctgttacccagtgggcagggcttcaatgtgtcaatcaccctgagctggagcctggttttcctgtaatcagactctcggctcctctccctgctggttggcagtcagttcctgctcccactttaaagccaatctgtctctccagttttcatcagagaagggtgtccattttttccccccaaacccctgctgcatttggtcaccttgtctcattcattgtctcagggttgcaatgcttcggtgtttattgactttgcccttgatatttttggagattacagccaggcatcttattgactttcttttggcttggctctttgtgctgttttggttacagttcacttagctgggggttaaagtctggagacttacagtacagaggttatgtgtacgtctctgtatcacacaggccataatgtcaacatgatttattactagtcttgttttttgatgtataatttcacatttattgtgttaaatggagacatttactttcatttatgttatgttgactttacatttttttcttgcctatttcccttttgtatttctcccttttctggaaaaccctcctgtagaatggagttgtacaaaagtctgtgtgtgccagtgtatggtccttttcagtcaggagaagctggcttccatcagaataagaggtttacatgtctttctgtgtccctgtgggggaggaaacatagacatgatggtgaagccaaggaacctgtccccaggagggccaagtagagagaagagggttgggtttttggactagaatgttccaactcttcagattctgcaattgttgacccatgcctgtttcataacccaccaagtctgtcacagggccactcatggcaagcaacagatgtttagagatcatatgtcatggttcttcaggagctggaattcaaaggatggatttctgctctgtgcagtgaaaatagcaggtagcaaagaagaaggggcgtgggtgtgaccaaggaaaaaattttaacctgtttccttttctggtgactacaaagggtgttttgaaggcatggcctcacctttgcctccagtcatggaggttacacactcaggcacacgaatgaagacttattagtgtgtgcattcgtgctcacgcgtatatgcaagctgtgtgtgtgcatgtgtgcatgcttgtgtgcctgtgtgtgtgtgtgtgtgtgtgtgtgcatgtgtgcatgcttgtgtgcctgtgtgtgtatgtgtgtgtgtgtgtatgtgtgtgtgcatgcttgtgtgcctgtgtgtgtatgtgtgtgtgtgtgtatgtgtgtgtgcatgcttgtgtgcctgtgtgtgtatgtgtgtatgtatgtatgtgattatcagagagcccagcatgttgagttcagggcctgtctttttctttttgtacacaaagacaaacggtttcaagtttgaaatcagctaatgtaatcgattggacatttatttgatacttccatgcagcatcctgcttcgggctcccgagtcttctttattttgtcgttagagattgttgctatccagatttggggttccaaaatctgagggtaatgaggtcacacagcataaggtcactgacctttgaagcagggctgagaccagagccatggttcacatccctcccgatctttgaactttgtgttgttcttttaagttaaagacgcgtgctagatggaacaccaacacgagatacattaaccgtggagtttattacaggggggccggggaggggagcggcagggggtgaaaagagagatgatggaagagagagcaagagagagcaagagcagagagaacagtaagagagtgagagagtaggagagtaggaaagcgtaagtgggtggagtctgtctttaaaggggtcctttacacctgcgtgcagacttagtactcatggaaccctgggctgaccagagcactgcctgagtgcattctgccaggtgacaggggcagccagcataatgcctgagtccttacacgttgcttgcctggagattctgcctcgtgttcacagctgcccgagggagtcggaacctcttcctcacatcaagggtctgtttcaagggatttcctgcagctcctgtcttctgtggtcttgatatgttttaattctttttacatgccatcaactatcagtttctcagggattttctggccatcatatggtcttgttagttttctactgaggtccctgttggttagtttgacacttaacaagcaccaaggactaaacatagtacagttgactttattctggggagaagtgtagatggaagtttctgtcccacccagtccccaggccgtttagtcccaagtaaacacacagaggcttatattaattataaactgtttggcttatggttcagacttcttattggataggtctctcttaattattagcccatttccattaatctatgtatctttacatggccttggcttactagtgaagcctggtgctcttgctcccgtggcagctacatggcatctcactggtgactcactctctctcttctccttcccagaattctcctggtctggtagccctgcctatacttcctgcctggatatatcctgcctgtccattgtccaaaacagctttagtcatctacaaataagagaaacatatattcacagcacacagagggacttcccccatcagagaagccatcttggtcgtggagactacactgtagctcaagggactttctccctttgcttttccagtgaacccgaactgtgatgtaatgatttgttgctcagactgacagctgcctggatctgtattaggaccttcagcgttcttcacggggtgtcactttgactgtagatactgagcatttgcggaagtcaccctaataactgctgtctatagctaatcctctgtcactaaactcccagttggggtaataatgagtctattttccttaatgagttcactttcttcagtgatacttcagagaagagctgaagggtgaggagaagtacattccggcgcctgtttgaatctcccatggagctactcagagttacagagatcatgcattttaaaatgctggagagatggccccatggtgagagcactggccactcccagcacccacgtgacttctcacaaacagctgtaactccagtcctagggcatccaatgcccttccctgaccctgggtatcaggcacataggtggtgcacagacatgcatgaatgaggggaaaacacccataaacataaagtaaaataaatctaaagcatgcagtgttcagtaaaaggagattcttgtggttttgagtgataaggaaagggcatgaattgttgaaaaccttgcaatgagttatatgtctaagaaatgaatattgcatgaactttgattagtttgtagatttatttttgaagtttaatcgctcccctatgagtaacaagtgaggggctaacaaggtggatccgtgagtaaaggtacttgttgaacaggcttacaaccttcgtttggtccctgggatccataaaaatctggacatgtccgggcgttggtggcgcacgcctttaatcccagcacttgggaggcagaggcaggtggatctctgtgagttcaaggccagcctcagggtctacaaagtgagttctagtaccaccagggctacacagacaaagcctgtctcaaaaatcaaataaaatcaaaacaatttgtatatgctggatcacgcttgcaatccaccactcttaagaggggtgagaggcaagacaggagaactgcctggaagcatgaaggctgcttgcctggagcatactattgcagaagtgggaggtgctgccttgttaagactgacagcaagaaccagctcctgaaagttgccctctgacctccacaggtatgctgtggagtgcacaactacacgccataaagccatatcatgcacacttttacaactgacaataagtaaaaaaaaacaaactcgtgttgtaagttcgtgggtcacggtctcccttcaaactacacgggaagctattggtctaaattcctactggataaatatcatgatctgagaattttaacagctagcacggcaagtagataaaactgtgacagagagttctgggggctgctcagcagcttaaggacacttgtagaagacctgagtttggttcccagcacccacatgggaggctcacaactgcctgtaactccagctccagaggatctgacacactcttttggcctccatgaaccacccaaatgtgcataattaaaaacaaacccttttcttttttaaagatttattttgtgtatatgagtattgcctgcatgtatgtgtaccctgtgtgtatgagtatcacgcatgtgcagaggctggaagagggtgttgcatctcttggaactggagttacaggtggttgtgagtcactcaaggtaggttctaggaactgattctggatcctctgtaggaggagccagtgctctgagatggcgcccaactccaaaacaagtctttaaaaaaaggtgttacatgtggaaattctcagctttgagttcttaaaatggtcttttgtgtgtgtgccatctcacgtgatctagtattatcctatttttaccaaggtgcaggccatactttaagatgggaagtccatgctacggccgtgcagtcagttaaaagtagactgtcaacagagatcattgctacactccagacaaaccggagataaacatagttctcgaggagtttataatctaacgagggagataagaggtgtatacaaataattattagtcaaggtagaaatcgataagggctaaataaaaagctacaatgatagaggtattgtgggagatttgaaattcctgctctaagtgcagcccatgcttcttaattaggttgcatttttcttggaaggattgtccctgagggagggacacctgggatttcaggccaacaattcgacttttcatgaatgtcattaagaaactattattgctgcctacctcagaggacggctctcaggagtgtgttctctgctggctacagttactgtgtagtggtgatgactggtgtgtatggcagcgtccggatgcctccttgaactgtgatgttatccaccagccctgctgttctcttgagtgaccagagatggaagcaccaggctgtcatcactggagatatggttgggtagaggcgggggaattaaggagttcaccagacccaagataaagatgaataggtgtttttttaaagaacaacttacgcaggtaagagaaaataatggcccggtggttcctgctccaaaagatgcagtctctgttccccgagagactaaagagagtgagcaccccccttctctatcttctgcacctgaaaccacgcccaaaagggtgtggtcgctactgcaactttcactggcaaggcaagatgccactatagtcaggaacaggtgattgtaagtgattcaacaattgatgatgattaaaaaaaggctcatcagcaacaaatatttgtcaagtccttactgtatgctgattgctttatatcattaaattatttaatcctacccaatgagccttattttaatacattcttattatctgttgtttacagaaatccaaaagcctcccctttcaaaacaaccccaaaactgttccaacggctttccctggagagacaacagcgcatgtgttactctctccagaaagggaacccacagcagataaaagtaacagttgcacccgtgagtttttaattggggtgaaaggttgcttctaaggagtagggataactcaaaagcagcaacatctcaggaaagccgattctagcataggtgaccattaggagcattgtttaatcgcttttataatgttggtacaggccctaaagaatcttccaggctctaactctcttcaggtacccggacttcagtttagtcatgtttactacctgggactcctggagcaaatgtttcaatttggagagaatgttgcgatttggagaaacaggcccgatgacaccaatgacttatataggtcaaaggtttatttatctttcctttaacagttgctaggtgactgatctgggacaaattaaattaaacattttgcatagccactctaaacataccatactataagcatatttaaagagatttgttttggggctggagatattgctcagtggttaaggacacaggatgctcttccagaggacccgggttagattctgagcacccacaagcagctcagaactgtctgtaactccagtgcagggaaaccatcttctcctggtctctgagggtgccaggtgctcacatggcacacagacatatatgtgggcaacacacccattcgtaaaaataataagataattaaaaaatttaaagatttctggtgtgtgtgtgtgtctgtgagagagagagagagagagagagagagagagcacagtgtctgtggaggcccagaaaagggtgttgaagcctccggagctgtagcaacaagttgttgtgagccactcaagtgctgggaactgaacccggattttctgcaagaacagcaagtggtttttttttttttgttttgttttgttttctgagacagggtttctctgtgtagctttggagcctgtcctggcactcgctctggagacgaggctggcctcgaactcacagagatccacctgtctctgcctcctgagattaaaggtgtgcgccaccaacgcccggcatacagcaagtgtttttaacagctgagccatctctccacgacaggcaggcatattgtgaaatgttgaattggctcagttcttacattcttagcatgcataaaagtatgtccagtgtgtgtgtgtgtgggggggtgttacatacctgtttattgtcattttaaatttagattagttttgagcctttcatacatgtatattatatttacattttttcaaccttctctcttcctgcttcaacttctattgtgtccccactcgcaaattcatgacctctctttctttaaaattgctgcacaccccttctccctcatatgttgatcctctgagtgtcacttgggattgcagaacctaccagggatttatactagagaaagggattctccctttctctgcagccattaattgcctgtagctctttttctaggagtgggctttgagatatttccttcatccatgttgattttgtgagcatttcagctcggatggaattccttggcagccaggagccaaggaataccacaaagtcacgctgcacagcaaacctaacgagacagggtttctctgtgtagctttggagcctgttctggaacatgttctgtagaccaggctggcctcgaactcacagagctcctcctgcctcagtctcccggttgctgggattaaaggcgtgcaccaccacgtaattgatttagtgggagggaaaaagccaggagggtgactgcttctgctcgggcaagaaacagcagcaaactgatcaggatgcagggcttatgtacagtttcttgggaaggggtgaacttttcagggtggagctttccttgtggagagtgatgggatttcatgtccagacattcggtttttaactctgtagggcaggggcagggtccagaagttagggcacttagagtgttctgtgggtgggacctggcagttagaggccttgggggaggggcttacagacatatcattcggagttgtcattatgctggtctcttttagcaacatattgctgggagttcaggggggcatcttccctgctgtgtctagatggtgttatctagcagcaggtactctggttcttgggctgttgtaatctttctgccttttgctgcttttcctggacttaggtgtagtggttgctttgcagatacatcagtcggattaggttggtcacttctctgctgtttgagcagttgtggttttctgtgatgatctttgtcttctacaaaagaggcttccttgacgagaggtgagagctgcacttaactgggagtttaaggataagagttcagaatacagttagcaattacatggtggtagtgggttttcctctggggtgtgggatctctccactcattggtagttggctaggtttagagtaccagacatgagttatttcttgttgaataggactaaagtcaagtttgacaggtgttggttacccccaagataacaatgccactatggcacccctggggagatcttaccaggacagtcacaagcgtggtttgtaggctctacagctaggtaggattattgatccttttttcctccctcggcagcttgcacagctccttctgataccatgagagctagtcctcaaggaggaggcttccgagtcagttcagtttcattctcccaagtttggtgttggaagtatatggtgtcttcagtcatagggcctgcccttcaaccagggacaatgacaatagcctgtgctgtttggggagactcttggacaaagcactattttaagtggaaatacgcacagactaggctggtcctgaggtaggtgtaccttgggtctccccctcctgagtattaaaaagactaaaagtcctgtttcatgtgtgaagtccaggtatctccctgaaatagcacaatctttactgttcttttgagttagtaagacattctaggtgagagattgatttctgactcgtgtattccagatcccagtcgactgccttcctccttaggtgttgactcagtgacccagtggtttcaaggtcctctgatcaggcgctcttgtttatagtctgtggttttcatggcaaatacagcaatttcagaagaaagcaaacagtgctggcgggtggtgatgtttgttttgcaaacgcttggaagcggtttggaagccgtcttccaaagaagaaggtgcataataacctcacaaagcctctctctctcttcagccgctgaaatccagtctcagctggctgcgcaccacccgaggtggttacacttttgcttgcagagagcagtgcaacactagaacactggaagaagataagccgacctggggagtgtcctgtcctagaatcacagtgttagacccctggaaaactcaggtatccggggtcccaggccacgactgcggtcaccccaatcaccaggtggatttgagagcttgctgcaaactgcatgaggctttattgtaatttaacgagctaaccccatgttagctcgggtctttcacccatacgccgtgggcggatggctagaaaagacagctcatagggcctcccaagagatcttatagggcagcgtaaggggagtgtctaggggtaagcacaggctcaggattggtgtgcctccaggcctggagggcttgccctgtgttgattggcccataactggttgttatggcccataggccctcccagggtggttgctatgctttgtgcgtcattgctgtgcgcttgtccgtaaagcacacccagagccataaagcatagctccaccagctaaattctgaggggttccttgtcacgagacaggcatctgactttctagtgactaactaacttctgattggttccttgtcacaaggcaggcatctgacctctaagtgaccaaggcaagtttatggcaagcacgtgttcggctgttatggctgctgaaaggggagctggtcccttcaacagatgggctgaagatggtgttttagggtagcatttgagtcattgtgtagttgtactgctttttgtagggagtccttcatgaagtctgggacagccttctgctccaaagaagtttcctgttaagcaatttgaactctgattgtatctgcataatgaaatgcccagatgtgggaaaattttggaagagacatagttgaagagagttggttttgtggctaggttctgaagtgtggttgtagacaaagaacatccaaatccttcaaaaggcacactgaaaaaacaaacaaagccagctgttatggctgtccccgtgtggacaccacactggggctgatattttggtgtaaaacattagcaaaaaggattttagtatctattgttactgtatttttgtgtatgtgactgtatatagtgtgggcatatgtgtgtattcctaggtatgttaattggtgtgtatgcaactctgtgggagtgtgtacaatggggtgtcacagccagagggcaacactgagtatcttcctccttcacactccaccttatattaaaaataatttaaatgtgttccgtggcacatgtgtggaggtcagaggacaactctgtgaagttgtttttctcccttatctgtgtatggcttctggggctctaactcgggttatcaggcttgcatcttagggcggccagcaccttcacctgaacctggagcttgctattcagcttggctgaccagtgagccccagggatcctcctgtctctgccctctcagccttgggattttaagtgtgtgccttttgctgtgcctagctttctattctttattttttctttctattctttttttttaagtgctgagaatctgttcttaatgcttgtaaggtaatgttttagctagctgaaccatcacttaactcctaattcctattcccaattacagtttctcccagtattaagaaagttaaagatgcaaccaagtgatggtggcacagggctataatcccagcggatctctgagtttgaggccagcctggtctccagagcgagtgcaaggataggctccaaagctacacagagaaaccctgtcttgaaaaaccaagaaaaaaaaaagataaaataaagttaaaggcgtgtaggtacctgaaccaatagagaaagtagtttcctactttcacccttacatggaggatgggcagctgtgcctaccgggctttccctgatggcctctctttgcctttctcagtaagtctgttaaaaagcccaggttccaaggagcctagaaatgctgtctttgctaaccaaagttttggtacattgtcaggtttttgcttaaattagaaataaaggagtgcaagatgagacatgagtctaagagacattgtaaccagtttattatatcatggagagcgagtgagagagaaatagaagagagaagaggcggagagagaagagaagcaaagagaacagagggaagagagcctacgtgggcagggtctgtctcttaaaggggtcctctacacctgtgtgcagacttagtttccatggaaccctgggctgaccagggcactgcctgagtggatcctgccaggtaataggggcaggccagtataatgcctgaacctttcaaagtagaaagtggagaaaacactggcaacccagagaatttactgcatatgccctgtgtatttgctggtgtagtgtactgcagccaggcagcaggccatgacctgaactaggtgacaggaagaggtgtggactgggtacccctgtggcttctctgggtcttttgagaggaggctatacaagatccaactatactcataacaactctaacgtgttattggctttcttgagttttgttctttcctgttcatacagtatcttcgggagctacatgacatggctttgtctggtggttgaaacttcaataccctcttcatggaggagaggaaggcaggggatgtaggcactttggtgggggggggggatccgtgattctcagggggcatgatcagggatggagtccgtacagcactcctctggattctggtttagttttaattcccgtcctctctgacagagttagatttttcttgggtaatgaaatttcatccagatgactaaaggcagttatagtcacccgaccccctgttctgtcccctgagggaattcggtagaagcctctcgctgtgcttaggagaaggagtaggggagaaccaaggcaaggggaaggctggagactgcagtctgctacgcctgcttcagctgggcacatcacagcaccacatctgggggtgtcattatctgagtcctgacacacttcctgaagtgctgagcctggctttagtttatctgtatcccttatgtgaaactaagttctaggttctcttggttgctacattgtttgccttctttactcagacttggcttggatttattgaaagtgattggcagtaggttacacaccttgctctgcccaaagctactctttcagtgttcaccacctttagtcagtctttgtaggaatgctgtctgtcacctgctagcttgtgggcaggtaccagcgcacagtgtcagtctgtgtttcatttgtctaaatttgcctgttgtttgtgaaaccacttttaattttcttaggcaagatacaattttacaatcgaaattgaatccgacctcagtatttaaatagcagctgtggagggaaggccaacagttacaaatggctctttgccttcctttgaaagggagcctttctgtggggaaatgccttgcctggccaccctgggctaatttacatggaaaaagggaaacacaggattcatttgaatttggtgcataaattatatccttgccagacaaatgtgaagggacaaatttcagcatttctcagacaggacattcttaccacaagttagttaatataatgaatatggcccagtcaccgccatctggtcagaagtggatatttttttggttgtttttttttttttttttctgtagcatttaccgatttacttgagactcactttgatagacactgggttagtcagaggtagatggccttcctgttgtaaatcagcaggagaatccacattggtctggacctcaatcctggagaagaccctgccagtttgtattctttaccgaggcttcaccggggcaacataaactctctgaaagactatttaagctttacaattatgttcctgttgccaccaagtagaaaataagagcaaatgcgtggttttatgctgcgctcatgcctgtgctgtaaggtttgtttcttttgggatctcagttctgcacagcatcctcttgtgactaaggaatgatttgttccttttccatgaggagcagctccctgttttgctagggttgacttgactctgagctctgcatcctgggggagaatctacctctaagtctcaaggttcagcattactccctgactcatccttcacattgccatggtgcttccttacagtgacatctttcagacacccggagactttccagatatgtttgaggcccggagagtttcacaggtgttgttagcaaggacatttgactctattgatttgcatggctttataggtcaagagaacagggaaccattttttttcaggttgctgcaggcctcttacaggacaggaaatgctaattttatttgatcctaggagaacatagaaatgcctttgctagttcaggtacccagctctagctagggagccgggaccactgaggaatgcctgtgcaggctgctgcaggtgaaatgacctcggaggaaactaccaggcctgctactctgtcctgcctgggcgcctccctccttccatccctccctccctccccctctccctctccctctcctccttcccctccctgtgtcatcctccctttcttcttctcttctccttttttttcttcctctgtagaccagcctggtcttgaactcacagagccacctgcttcagcctcacaagttcttatagtatcaattcctattaaactcttaacatgttcagtgtctggtgaaggcagaaagaagacgagcagggggtgatgggatatgagaaagtgtggcagagctgggaagagaccaatcagagaacaaggcaggatccaggcgagggagcagctgcaggacaaggagcctggagagaggagcgcacgctgggtttttaatttgggcacttttcttttaaatcatattttagctaacatcactatccctgggattacaatgaatagaagcaaatactcctagccctctcagaactgcctttgagcttccagtctgccttagccgggagagtctgagctgccagccatccactctggctttcacgtctcccgtgttcccagaggttgttctcatgaggtctctgcctaaaacattgtcacagcaccaggtgcctctgataaattttatcagataggcagaggaagagtaacagttgtgctaagcacacatgttccggattcaaagacttatgtgcctccaagagagtcagctaagcattccccaaactgacacggcacagctgagatgactcaggctcaagctttgtggcagcattattaatttctagggtgcttaaaattaagacaagttttaaaattaatttattttttgagatagggtctcaaaaaatgtttttttctggttgtcctggagctttctatgaagactaagccatactcaaatgcacagagactcacctgcctctgcctccccagtgctgggattaaagtgttcactaccacacctggcctaggagattttagatgcctactatgaaattttaaaatgctaaaaaaatttaaattagatttacttatttggtgcatgtgcttgcacacgcctgacacatgcgtggacgtcagagatcaatttatggcagtcacactctcccaccatgtggggtccatgacttgaactcaggtcctcaggctttgtagccagtgtttttacccactgaactatctccacagtttctaattgtttcccttgaaggagtctggggcaacccactggggatcctctgtgttgccacgagccgttattccactctttgataaaaccttgctttccttcgctgcaaaagaacctgcttacccatatagtgtgctattactaccacaaatgcacagaccttcagctagacacacagctctgtaattgtgagggagtctgcatgtgcttgggataattttatgtctgggttttggacatttgaaacttctggtatgaggtgatgtgcttgacatttcaaggctggttggcctgagccgatggaagtttattatgaaaacatggggaagggaaggaagacagaagccagctttggtcacactgcctgggcctcatggctacagcactgtgtgtgagtagcgagaccggtcctgtggatgccacagcaaccattaaaactgctcccgcagagatgactcgccactgctttgaactctgagacacagtcatctttccacctatttgagttgatgtcctatcacaaaaaagcgagtgttaactttccgtgcgggaggcatgaccaaatatctattcgggccagatggtgcaccaaagatagacaaagaaatgatcccacccaagcccagcacagttcaccgatgagttcagcaggtttgctgttgggagcatggctgacccccaaacatctgcaccaccaccaagtccccctctggcatgtgtggtgagttctgcaaggctgcatctgcattgactcccccccctccccccgtagttacccttccagctgccagcacctcccaacatcacatacagcagaggctgaggtatacacagtgagggtgcagcagggagcgctgggtctcagctgcgggtgcagtgcacttcctcatccattccaggagggaacatccacaatcctcagggatggggttcttgtaggtcatcatggcagctgtgactaagatggcgaaggctgccctccttagatgatggcacgccacacacagccagccacgcgattgtgttctgcacaggttccaataataccgaactgtacacatttgcatcatacacaaaagaattaaggatagagaagtaaacatagcataaatactttttttttctagtattttctttgatagtcccccagaatgcgcacctttttgagagccttctgtcacagtgtttgctgtcattatgactcaactgtttttgctgcttgggtgatgtcagctggctgcgtgatcatgggcagatagcctcatttaactcacttctaaagtgaggtaattatgtgtgttttgtagaactgctttggagattgaactcaacaagatgtttaaagctcttagggtaatggctggcctgctggctgtcccccctcaggtgtgaactgctttctgttctcctcaacctccctcctgctcatgtaaggtgtctactttctgctcttctgccccggggcttggcttactgccctgtttctgccggctgtcttctgagctctcttgtgtagacagagcatccagttaagtttattggttgtgtctgtctatcccatttccctggaacaatcctgacttggaccgtggtcgcagtgcagttggcatagctctttcatgttgtcaaggatgtagttttggaaacaaaggttatccttcgtaagaccaccatgggcccgtgtgagaaggtggactccttgtgtgacgactctctccctccttggcactgcatgcctagagcaaccgtctgcagatgacacagtgacaagtgacgtattgactgcaggaaatgatgggacgatagggtcggcgagcatggctcagagggatttccagctctgccatccagggacacagagcccacactttagatgaggcctgggcagttggatcctataaccagggtgactgtctatacagatgcaagagtgaaaggcaagaatgtttcaaacattgaaacatgtttagcttggaaatctaagtctctgacctgaagctcaaattcatgatcaattttttcctgattcgagaaaatcttctcctaattcgggagcgctgacacaccagaccctacccagtgttgacagcagtagttagaaataggtcttgccaaatggggaacctgcctaagaccgaactagatttcctttatataggtgacaatgttgcgaatgggacaatatatgaggccactggcagagggtccaagatctaacactaatgcacagactgacttaggtgagcccattctatatggagagatgccttgcccagcctagacacaggggtgtggggggtggagaggtgccttggtcctgcctcaatgagatgatgggacagacttagtagacttcctaggggaggcctcactctctccatggagcaggtgggaggaggggggagtgcagggcttgagaggaaaggagggagggggaactgggattggaatgtaaaaaattaattaaaaaatgaacaaaaaatagactaagattaaaaggtagaaagtagaaaaaaaaaaaaagaaataggtcttgctctgtaagaggctggagagcagtggttctcaaccttcctaatgctgtgaccctccaatccagttcttcatgttgcagtgacccccaaccgtcaaatcattttcattgccactttgtagctgtaactttgctattgttaggaatcatagtgtaatattttcttttggagatagaagtttgccaaagaggttgtgacccacagtttgagaacaactgtgtgtgtgagtgtgtgtgtgtgtgtgtgtgtgtgtgtgtgtgtgtgtgagagagagagagagagagagagagagagagagagagagagagagacagagagagacagagagagacagagacagagacagagacagagagagacaggaatcatttcttattctcatggtgtctcacctaagtctattgttcttcacgtggtgaattttctgtttttctccacttttcatccctttggacaccaagtcgatactgaatagcggatgtaaagatcccgtgacagtgctggggaaattccatgtgattcatgagttatgacatcatgctgaggcagataacttaaaattactcttttctttatgaagtcgtagaagacaaggctgtaattaaaaatagagcattaatgcttttgatattttcctcaaaatgcttatcatgacgtgtgcatgatccatgtgggcacacgcatgccagttgactctctccttcccgtgctgcttctggggatcaggctctcgctgcaaactccttttccccctgcacccttccttatacattaattttaattaacactcaacatgatgactctcattatgacagtcttatggatgaatatcatattctggttatattcagctcctcgcatgtttattttgtcttttgagatggtctcacagtgtagcaggctgacctcaaactaagggtcctccttcatcagccgtttgagtgctggggttatagcgtgtgccactagactggcaggtgtttggttttagtactactttcaggacattagccagaattgttaccattgagaaaaagaaaaaagcccacccaaacaattagatgttagtcctagcattattattattattattattattattattattattattattttgaggtttattattattttgaggtagcaagactttaatttcgaatgtgaatgtactgtttggttgtgctgttcatgcctgcaacactcttaactcagggaaagcaagagttcctgtgttctcaagattcaggagcagatctaaggctgtgcttgtagctcagtggtagagtgcttgcccaacactcaaaaggtcctgggttcagttcccagcactgcaggaaaagaatgaggaccaggggagagatgctctataattaatgtcttggtgtccctttgcttgctcagaaggaaacacagcaattggaactcattagaggagtttgacggtctcgactgaaaagccaccaagtttggcttctcagcagcacctggcattgtccgtcatggaatgagcaggggctttcccctagtctctaaggtctagagctttgtgggtaataatctgagtgactgtggctttggaccactgtccattttcagctctcacttgagcatttaaagtcagtgctaaccaatggtaagtccactttgtgtagctcccctgtggatttcaccgccacactgcagtgcaaacatttaatagagggtctaggagctggctcagggggtagagtgcttgctgtgtgagtgtgagggcccgagttcaatccctcgggcatggtgtgtgcatgcgattctgttgaaatggagacaggtgatcctgtggagactgacgaccagctgaattggcaaaccccaggacagtgtctcgaaaccaaagtgtataatgattgtgacaccccaggttggcccccacatgcctgcacacacatgcatccgcacacgcatagacggtttcaacggtgtcttggctggtggactccgaggtttgcctgagtttttcatttgttccatcatatatgtttcatggtccccaggaactcaaaagccaaataagcttcttggtctccccagcattgtgtcactgctgaggagtgtgggctcctgggaggaagcttgttcagatactaggggtggtcatggcatctgtaagtgtgaaagcagggtctgtctcacgtgagaaatgggacacccagtggacagttctgcagacagctggggagccacaatcctgaggctttcctgacaagctgggtgagaggcaccttcctgaagtttaggtgggaatgactgtcacccagagaggtaattcctgtgtagtcatttccgaagattaagaacacttgctctggctggaaggacctgtattggtagaaggttagtaggcctgctgaagacccgtggaaggagtgagtcatgttgagagagcctgttgaagaataataactaaaaaaaaaagttaatgaaagattagtatgagggaggatacccaacacgggtcactcaacaaaaggcaaaggggggtgagttagaatcggatgcaagaggaaatattaaagccagtgttggaagagatgggcccggtggtggtagagcgggattggagtgggatggtgtgagaggtggaggtgagttaagcagagactttacttgtcctgtgacagttagcaaacagagaatggagcctaaagacaaaacaagggacctccatggacctgagtagaatttatagcatttgcatgcacattgtgaaggcacaaagatgatgagggttgactccatcaggttactaatatttctgaagtctaggagtgtggtagattatggcttttttttttttcattgagaccttgttggaatggattaactactttggaaaaatgataatctctctagtgaggaacctggaacatcaggggtcacagtcatagcaggtcacacaaagtcttaggggctcatggcacatacagagctctgggctggcagcagtgtgatatgttattaagagcaaggagacacggaggaagaggaagaggaggaggagggagggttgaggggtaggagagaagagaagagtaataagaacagtggggaaggaagcgagcaggcaagtctaacgaattactttcctttctaattttaagtgcctgcttctgtgtataaccgagagcttcagataaaacaaagtgtccttgtgtggtgcttaagattgtccctcagaccgcttggccctagctgctgattgctgctttgatttacctgggtatttagcaaggtgtgtttctgggagtttgaaagggaagctgggggtgtcttttgcttactacgatactcattttcatgtaaccactcagagaattagagcaaaattaattaggaagctaaacaaaataatgttccccaacacacacacacacaaatccacacacacacacacacacacacacacacacacacacatgcaagcttgagctcttggagagaaggcaaatttatacagcaatgcacaattttgccacacccagttttgggtcactttgtggacaccgagtttctctcatgtatgtgcatttaactgaggagcataaattagctgtgaatgaccccagtgtggtaagtgaccaagcgtgggggtctgccaagccaagtctgtgaatctcttggcaagctagggacaacacaactggctgggtgataccacccacagacaagaaccctcaggagttgtcaggactgtttccacagaggcacctactatgccatgacccagagcaatgcagggagcagtttccagcttccaggaggcaaattaccagggtggtcttcgcttatttcttgtgcaaaggcacaggggcttcctgggccccaaggagaacactgctgctctctgaaagtgggattcagggagagaatgtgctcgtttgaatgcacagtgcaagcaggctgcagagaaacggctctgggagccatggcagagcatcccctgcttgggtgcactgtgcgtatgtgtgtgtgcgtgtgtaatgtatgcatacaagtatgcgtgtgtgcaaaatgtgtattgtgcacagtgtgtgtttgcatgcatgtacactctgtttgtgtgtgtgcacagtaggtgtgcatatgtatgtgcacagtatgtttgtcagtgtgtatgcatatagtgtatgtgctgtgggaaccttgcattttgagcttttttaatccacttggagtcccctgtttagattctttggggttaatcagaaatttaatgtgctgtttatgaatttggggtgcacatcatctagttagggagttaagagtcaacgtagaaaataaagaccaacaggatggtttgtatctgtagatggatagtatatatgacaggggaccaagaaagggattcctgtgtggtcatgtagtcagggaagcctcctggaagagtagaaattaggtttgtgaaataagttctttctcattctctgtctctgtctctctctctcccaactttctggagacagtgtctcacgccgtatctcaggctgactttgaactcactgtgtaatgcaggctggactcaaatgcatgaccatcctcttgcctcagcttcccaagggctgggatcacaggtgtgtgtcatcatggccagctggagttaaactttaatggaaatgtcagttattgaacatttgcggtctttgtgtctagaaactggattcagatttgggttgagtgagacctctgggaagctgtggacactctctgttaattgtgttcctgggaaacagtccacccaccctttctttttctctctgaaatgacatgttcttgtgtgtacacggatgtacaggtgctcaagtctgtttgtgcacatgtagagaccagagccagatatgggatgcctttctctaactcctcattatttccttgagacaagctctctccccaaccggaaattcccgctgcctcagcttggttagcagcccagcaagctctctggatgctgctttctcactgcccatgccggttacaggcttgtgcagccatgaccagctttcatgtgggggtggggtttgaactcaggtcttcatgagtgcacatcaggcgactcactttcccagatccccaaatgaattgttctaaaattttgctttttttttttttttccagtttgatccccctatagacttctgtaattgaggaattggtgcttccaggatggcgccaaagagcccttcttcaaacaatggaagtcagcccccttgctagcaatttttctaacaagctgactgttggatttgcagtttagaaaatgaatctgtagcttctactagattatcagccccaggattcagataaacaaactttccagctcaaggtggggcggctttcctcttctgtctggaatcagtcacacagaaggggaacgtggcatctaaccattaggggccccgactctcagctgagcagctactgctccaggagatcacacctgctctctgcctgtgtttgttcagggataaaaggagagaagcccaggggctcctgtgttttcatccagcagcctagggcctgcggtttctcattctccacgaatgagcctgctggtgcaggcaaagctgttgctaaccactgggcaggataggcctccgtgacctggagaacacacacactgctcctgcctggggtgtttctccattgaaaagccatttcatatgaagaaagttacacctattgctgctggcatagcttaaggttaaacttaattaattagtgtgtgtgtgtgtgtgtgtgtgtgtgtgtgtgtgatatgcattcctcagcatttgtgtggaagtcagagggtaagtttcaggagatcaaactcaggttgtgaggcttggtgacaagcctgttacccactgagccatctcactggcccagttggcctaacttttaacttgtgatgatctataaataagtaattgcctgtagaatcattttcttctgtatttcccatttttgtctgttgtatttttacctttttttttttttgagacatgttctcgtgtagactaggttagctttaaactcactgtgtagctgaggctggccttgaactcttgaccctcctgcctttgccttccatgtgccagaattacaggagtgtaatgccaggcctagccacattttttctttgcaaagctcctaacagccaccttaaaacggcaaggcagtcaccatcaacaacaacaaagatcatttctcttgggagaatcaggcgttgttattgtcacacagaacagtgtccagttctgtgagctgctgccatccagcacatggccaggattttcatcttggttcatctgtggcctctgtctcttacgcctcattcaaaatggacaaaacccctataggttttcccttttaaaatgtacatagtgctttctgcccagatctctggcgtggctctaggtctgcccagtgattctgatctccggcgtggctctgtgaccagtgcctcctctcttgtgtaatcctcccaacatatccttgtcttgactgtcctctctctgcagtcagtggaatgagcatgctaggacagaagttggggtacactatcaatgtctccatctcgctgtgagtgacatccagtgtccccattggcccccatgaccctgtgtaaactggctgggcctctgctttgtggcctctctgccatgatctggccactcaggggcccaccagttatgcctgtctacttctgttactgtcactcaccctcttcaggggccttcggggtctgttcacctctttggtgctccaagatgtcagcagcctctgttcaaatnnnnnnnnnnnnnnnttggtttttttacctccctccttcctccccccctccctccctccctccctccctccctccctctctctctccctccttctctctctctttcctgcctcagctgggattaaaggcatgcaccatcgtgatgagcttgagtgtccatgaacaactgaacgaaagattgaaagtattcacttgtgaatacaggatgaaatgtcacaggctccagttcaatttaaaggctttatcgtagatatgtattatatttgatcataatcagggtgtagagaatatgctcgtagtatctggtgccacaactggattctactcaagatttgtctaaaataaatggaaacaagaaaacacagtgctaatgtatgcaggcttggtttggtgggtgtacgcttataaccccagcatggaggaggtagagacaggatccccgtgagtttgaggccagactggtctacagtttacacacacacacgcacgcacgcacgcacgcacgcacgcatgcacacacacacacacacacacacacacacacacacacactacaatagaatgagaatgctgtgaaccaaaatttctttaatgataattcagtgagggccagggagatgactcagtggataaattacatgagacacaaagggagagagacctgagttcagatccccagagcccaggtaaaaagtcaggctgctgtgacagccaactttaactgtcagttcaacacagcctgaagtcgcctgtaaaggaatctcaatccccatcaggttggcctgtgggcatatctgcagggttttcctgattattgatggatgtaagaagacccagtccactgtgggtggctccattccctggacaggcggccctgggctctataaggaagccagttaagcatcatttcttcatagtttctggactgtaacctgtgggctaaaataaacccttttcctccctaggttgcttttggtgatggtgtttgtctcaaccagagaaaggaaccaagaacaccaggtgttccaggctgttctccccccaaattaaatggtggctccagcttcaaatttgtttcatgctgtgtttaggaaagtttatctcaggaaacttagccagatttacctgctgcgcccagggagtgtcttatcagccagccatcaaatactttggaaagctacactgtacagggagatctctagatcctgccaggcagcaggcaactgccccagtgttcccagcctgcttaccaggcaaccacaaacaaaacaggcagaggaaagctgcgtggctttgaaagcgtggtttctgtcttaggagcgtttgagaagcagctgatccatagagagcaggcactccagggtcaggtacagctatggccattaaaaaattaaaacagcaaacaaaccagtaatttatttactattcactcattttaagtgtttactccaaggaatgttggtaaattcagtgagcagtgagcaccgcagctgctcttccatcaaagggttcctccttccatccatgtgccattaccttcccgaacgtacagaacagctggacgcagtctttgcatcatctcctgctcacaaggacacagctggtgaggctgcctgtttgggttcgagtcttagcagtgccactttctggctctgggttaggctctaatctttaaacagggtctcatgatctgcaaaatgacagcagcgttgacgtctgctaaagaaatttccatgggttaaataatctatcgagtgtttatccgtgaaccatgtagaagctgctgggtgttggggaggcgcagtcttgaccgttcctcccaccctccaaagctgtcattcgttttaattttaaccattctgatgtgctttcagtcacatttccctaaaggccacgggtactggatatctcaaagtttcttattacatttctctctctctctctctctctctctctctctctctctctctgtgtgtgtgtgtgtgtgtgtgtgtgtgtgtgtatgtgtgctaaaagggaatatatatgcacagcatgtgtgtggcggtcaagacagcttgtgagagttggttctccctttctgccaagcgggcccaggccatgaggcctgaggcaagtgcctttacctgacaagccatccccaagcagcagcttttttgatatttgtttttattatttttaattatttataggtgtgtgtgtgtctgcatgtgggtgtgtgcatgtgagtccagacaccgttggaggccagaggtgttggaggccatggagctggtgttacagatggttgtgagccacctgatgtacatgctgggaactgaacttggttatctcttcgtctcttctggatgttttaaaatcatttacacatgttttaaacatcgtttaaaatgcttcttgccttcccttattttatgagtgtggtgcacggtctcatggcaccctgctttagaaaccccaggacacaaacacaactgtatttgttcatctgcaaggcaagttgggctaataataatgagtagtgacattgcccgaactgtgagtgttttaacctcataccaacacacactcagtggtagaaaacgcaggagactccagggctgggccttcctggttccagaatgttggcaagtcaaagcaaactgcagtttagtgaccacaacagagacaggcgagtggtggggactctgtgggtgcaggggcgagccctgtcctcttcgtgccaacctcctgaaaaccaggaagtgttcagacctcttcccgacacagatcccttctgctcgttgcttgtcccagcttgaggaataagtttgcctgcctgtgagtaattcacagtttcggctttgtcccccagttgttggcaaggttccctgatgctgaactaagctttgctttgatcctggatcaatcactatagggaaataaatcgcccctccctgctttagactggcagctgctcatttctgtgaaatgtgtttatatacctttccattttctagaatgcaacattttcaagtttttactgaagttccccagctaccacggctgttgtgcttgtgttacgatgcctgcagccccaggtacaagctcctttgttaggaagtcacttaaagtgtgactcctacagtggtggtccttttccttctgtgagggaccattcattcatcgaccagccccaaattgtggccccggcttttcagcaactccactactgtgtctatgaggtattagggtgattgcatatgtgtaattcaaactagatcacttgagaaaggaacgggggatgatttactatcaggcccaggcagctggaataagtcagtaatttcttaagcttgtccatggagtcttgggtatacagggctatataatcactgtatcaattttctgttgttctgacaaaatacctcaggctgcaaacttataaaaaaggggggcttatttagctcccactatttgaggtctaaggacatggtacagcctggctgtgttgaggactccgtttactacatcatgtgatgacgatgagagattttatagcgagacgggcagtagagggtagggggttccacaagagcgaccttcatctccttttgaggaagcatccccaatgacctaattgccttccactaaactccaccccttgaaggtgtcaccacctgtgagcctggccaagttccccacaagagtgctaggaccctagatgagccacgtccaagcacagagtcactctgattatgttacatttgtattttaagaactagtgatttgtacccgtcctctgtgccccctgtgttgtacctgagtgcttgggttttgtttccttactgtggtttttatgtttttgtaaagcttgactgttggtgaaagtacaaggaagtctagatttttatgtgtcagaaaacttgatgagcaactattctgcatatttctgtcatcatgggtggtctaaagggtgcctctctgggatcctcattcccaaccctcttcacttcctgggtgccaggctttggaggtaaaacaagaacagagattgtcaactagttctactgttgtgctctaaaatgtcacagaagagcaaggacgaacttctgatgactgctccttcggaagcttcgtggcagccttctgtttgcaaaaaggttctgactgcctgcacattgcaggcaggtgctaaacacagactcatacgcagacttgctgacgagtgaaggtagctggtggacactgctgtaggaaaggacaggcagaacgagcagaggaggaggaggcatttaaaggtttatttttatctttatgcatatgaagtgtgcatgtatgtgtgtgtgtaccatgcgtgtacagtgcccacagaggtcagaagagggcatcgagtcttctagaactggaggcacagatggttgtgagctgttctgtaggtgttgggacctgaacctagtcctctgcaagagcagcaatcactcataaccactgagcaatcgctccagtcccactgaacactattgcgactttcagaagtaaatgtgttttgtattgtaaccctgcgcaatgcatgtgtgtacacatgtgtgtaaccctgcgaaatgcatgtgtgtacacgttacagtacatggatgcatttctcaagagtggtgcagtggtgctcctgctcccctttccctgttcttcctgctccatttggttccactcagtcggatcttttccatcccattcagaggggatattaggatggaatggattgtttgattttgccatagacgatacatgcacacatacgcacacacacacataccacaccacacacacacacacacacaccacataccacataccacacaccacacacacacacacacacacaccacacacacaccacaccacacacacacatacacaccacacacacaccacacacaccacacaccacacacacaccacacaccacacaccacacacacacagtacacacacacacacaccacacaccacacacacaccacacacaccacacaccacacacacacacacacatcatacacaccaaacacacacagtacacacacacacacacacacacacacacacacaccacacaattatataagtatcacgtatggatgcatgcatataaattgtttcctttcttctcttttggctcttgggtttgtttaatgaaatttagagatgtgcatttgattcctgaaatcaattcatccattacacatttttttataaatcaccattgtgaacatgtcatatctatagtgggaaagctaagtgaaaaacattattcattgtgttttttcccccaatttcaaatgctgcttatccattgaaatggtctattgaatgttagaatccaaaccttaaccagaatataaattattcataatctatttctcttcttatccaaatgaagctttgtttctaagtatttactcattaacatttgaaccaggaaattaatctcaagaagaatacgattttgtaacattctcattgatgtatttacccttattttagtacattaacaaaatccccctaaaaacattcatcagtttcttttgatgtatgatatctattgaacatacgtgtgtataaatgtgaacatattccacagtttttatctagaagttatctgtgtgcacggctttagtaggatggatgagaagcgagccatcccttgctgtctggccagtatttttccactgtttatacttgctggtcacattaaggctttgctgttaattgaacagtcacatctattgtggtgacactaggacctggatctttctgtgatgatgaaggaaagtttaagtgcagaattccgaaggactctgtttggggacacgaggtttgtggtggaagctggtttcaactggttctgagtgacctcaagatgcacatgtagagttaagaacaacgtttgacgtgaggcactttgcttcaacatgaaaaaaacgtgtgtgagtaattgctttgactcatagctgcatagtgaattgggcttggaggccctggttcaaattccagatcaactccttagcccctttgtgggtttaagaactgcgttttcatttctgtaaccctgactgactctcaagagggaagagaaaacgctgtttgttgccagtttgtagcactttttactgtttacacagtgtttgctgatagtcaactgtgttgagggaacaaatgtgacaggaatgtctttactgtcaaggtcagtgctgtagtttggatctggaatgccacccccacaaacccggacccatgtatggaaagcttggtccccagactgtggctctactgtgaggtagagaagactccatggtggggcctagccaaaaagttaggtgctggtcttctatggaagggcggcttcccgccctccccgcccttctctttgcttgctttctgtgaggtaagtggttccctccatcacattgttgccaccatgatttactgtggcaccacaggtccaaaggcagcaggacctgtacttatcattaacttaattatctcaggtattctgtcacggtaatggaacggaaagttacctgatacaagcagtcatttgccagggcactctaggtactgtgtgtggttgctcttgtccatacgtgtaatgtgttctaatctggagagtcttatcaggaagaaccttgacaactcaggctctgaggttttgctcctttatctcagagaacagaaggctggattttatctgagtcccctttgaggcttaacactttagcattgcacagcccggagctatggaagacggtttctcttcccttccgcagtaagggctctgtgatggaggaaggagattgctgttttcatgggtgctggcctaagatgtgttgtgatgaacttttcgtgtttcttaatgcaggccgaccattcctcctgacctttgcagcctccttaggcaggtccaagggagagatttggtttgatatttccaaaagaacatactctctctgataacttctcaacattgagagtctgatacagacagtgcattttaaaacgagttccttagactgaagtaaaagccaagttacatacagctctgttgcagaccatcccacgaccagctcagactaccccacggccaggtcagagatgagtcgctgctgtggactggccacttgtcttcctgcctgcttcccaaggaagtgctctaacaacttcattcctcatgggcaaggccactggactcggctgtgtccccttccaaagaggagagcattcccagaaccttaccttacacaccttcctccccaagcagggagtgaaatctctggcagcaacgttccctagttggcatgaggtcattctacaaggtggacgtccgacttgctgaaagacaggcttgctgatgggttaatgcgttctactgcacttaagtcttaagacacctctaaggaggacgcatgaggaagcctgccttccctacacctttggcaagatgcactgagaattacacactggccttgactagagtgctgaaggtggtttctgggggacagaaacagcctcaggggcaaatattttaggggtacgaagcaaagcacttcaaacttgagtcagtggctacaggaagtggaggtgttggttgttttcccgctggatttcttcgtgtgtgtgtgtgtgtgtgtgtgtgttgggggggggcggggggggggttccttggtgttatcccgtgtggagtttctgctatacaccattaagaggtttcaagggtcatccctccacacacatttgaaatgaggctgaagcaagtacctctggtacttccttccaaagctcagccttggctctgcaatcctgtaatacagttccgtgtgttctggtgatcccccgcccccttcataaaattagtttcattgctccctcatagctgtgatttgctactgttaggaaccataatagaaacacctggtgcacagggtatctgatgtgaccccctccccaaaaggggtcacgcccacagattgagaaccgctgttccaaggccattagagaagaggtcctgatgttgagcggtggttttctggacactgcctgatgaacatgtgccttgctggataactgacataccccaatacaccatgttcctgcagattattggcctcctcggcgaaggataagcttgtaaaagaattaaactcaaatcacttccttttatttgtgcttttcatgattattctatgatacaaacttttttcctcttttttaaaaaaatttaattcattgagccttgagatgatgatgaggtggctgtctagttaaaaattggctctgaactaatttctgtactagtttcaagttgagagaatgaacagatgcaggaatttgaggagctaactttagttttgtttttttaatttttttttattttttaagttgtttttttttttttttagttcaaattaggaacaagcttgcttcacatgtcaatcccttctcctcccccaacccccacctgccccccaccccatccaccctccactccccaggcagggtagggctcctcgatggggctccccaaagtccaccacatcaaccttggctggtcctaggccctcccccatgtgtccaggcggagagtgcatcccttcacgtgggctgggctctcaaagtcccttcttacaccagggaaaaatactgatccactaccaggggccccctagagtgcagaggcctcctcgttgacatccatgttcaggggtctggatcagtcctgtgctggcctctcagacagcagtctggggtccatgtgctcccccttgttcaggccagctgtttctgtgggtttcacaagcctggtaccgacccctttgatcttcattcctccctctctgcaacaagttccagagttcagttcagtgtgtatctgtggatgtttgggtctcacactgtagcctcagactcatggcagtcctctacgtgagtgcttgcattataggtgtgttgccctcaggtctctggagagctaactttaacagcaggtttggaaaggtctggataggtttgggtgagtctgaattaggtgaattctgtgaacaagaagaagagggcctgtctgaggcgccaccctcgctggtactgtgacagaacctgcgtgtttgacttacaaggcagcagcaagggtttcctctgttcaatgctgctgcgttccagagccttcaagaattttatacaagctcacgcagggccgtcttccactgaaagggtggacacgttgttaattgcacactcttggggtgtgttccggctgaacttaagattgctggttttttgtggcttgctgagggcttagtcacccctctgtcttcatggggctctgactgagaaagaggcaacatcactcatactgcctcacacttatgacaggccttaaagctcacagagagattccacctagattatctttttgtctatctcagcacccctgtgaactaggtgggggggcattagtaacactcttgctaggcagtaaatttagaattggacaacatatctgaccagtccaaggatagtatatattttctaacatgctctaaagaagtcagtgagagaaaaccagtcacacctaagctccatcccaataacaacttttcacagaaggtgtttgacctatgttccgtcagtccagactgtcttgcagtcctaattctcatgcatatttactgacataaaatgagaagtcacccgttggaagagttccaaggagcagtctttatgctcctccagagcccccatgggaaactttaagtccacagtgagcttcctgagggtgggggctgagtcataacacccaaggcacaggcaggactcctggcgggattacaataagcaccgtctgatgtctggtatttcctcacccattcagccacatactcaggcctcaatgctgtctgtacagatgttgtcctagctatccaaagatgtcatttcaaaggagcagcattggggtattctaaaattcaccacaacatatatttctgtgtcaaaagaccccttcctgatgaactatgataggaatctgtagcaacagtgaggggccctactgcttctctttccacaagtgaatgagttgatgagaatggcccataggtcacagggctgtgttatgcatgaacatcaacttgtgtttttgctgcaccaaggcaatgtagtttcgttactggcctcatatttgtcaaaataatctacggcattagctcacagatgtcctttcatgcttgcttgtgaacaaacaactttagtatttatgcttcgaaaactttgtataactctctttgttattgctaatatgtaggaaataatttctgagccttgtaggataatgctgccaaggacagcatgtctcaacggcagcctttggtcttcacagacatgtgccaggtacttctgagtcacattgcagccgtgatggtcttcaagcctgggttaacattttgaaggtgccattttctgcctcatataaactattcactctcaggatagggttatatcttagtgataaatcttagtggatttatagcttagcgcttacttagcatgtgcaaggccgtgagttcaatcctcagcactgccaagcccaatgaacaaatgttgatctatagtagtattttaggaatttatttagttttgatttatttattttatttatttagtttttttgagacaatgttttaaaatcatttttatttagatgtatttgtgtgtgtgtgtgtgtatgtttgtgtatgtgtgtctgtgtgtgtctgtgtgtgtttgtgtgtgtgtgtgtatgtgtgcaggtgtgtgtgtgtgtgtgtatgtgtgtctgtgtgtgtgtgtgtgtgtgtgtgtgtatgtgcacatgtgcatgcagtacctgtgaaagccaaaagagggcatcggatcacttggaactggagttacaggtggttggttgtgagttgttcactgtgggtactggaaaccaaacttgggtcctctggaagagcaggaggtcttttaaccaccaacccatctcttcagcttcatattggtatttttaaagtttgaaattatggattgcttttctggttattaaagtggaacgattgggctggagagacggctcaggggttaagagcaccggctgttcttccagaggtcctgagttcaattcccagcaatcacatggtagctcacaaccatctgtgatgtgatctggtgccctcttctggcctgcagggatacatgcagaaagaacactgtattcataattaacaaataaaccttaaaataaaggaagtggggcaattgatagactttgtggtccaaacaagatgacttagtaggtaaagggctctctctgctgtatcatgacatgtgctttattcctggaactgacaaggtagaaggagagaaccaacttctacaagttattctctggcttccacagtgtccaaaccaaccaaccaaccaaccaaccaaccagtgaatagaatctatgtatataattataaggtcattatgtctcctgttttatttttaatttcttaaacatgctagtcatactccttgtcttagggttctgttgctatgaagagacaccatgaccgtggcaattcatataaaggaaagcttttggttggggctggcttatggctcagaggtttagttcattatccttatggtgggaagcaagatggcacacaggcagagagggagagaaagagagagagagagagagagagagagagagagagagagagagacagagagacagagacagagacagagacagacacagttagagagactctgggcctggcttgagcatttgaaaccctaaagcccaccctctgtgacactcttccttcaacaaggcccacaattcctaatctctgctaagtaaaaccactccctgatgaccaaacattcaaatacatgagcctgtggtagcattcttactcaaaccaccacagcccttgatcattttataccattagaacagttaagactgtggctgaatggatatttgactctactgaattttattttttttttgatatacacttaaagcgagactgtctctaaatagtagtagcatatttgttaaaacacagtaagtttttttttaaggatgttttgttttagtttatttatttatttatttatttatttatttatttatttatttatttatttatttatttgtgacagagtcttactacatagcccaggctgtcctggaactcactatgtaaaccaggctgaccttgaactctcagagatctgcctgcccgtgcctcccaagtgctgggattaaagaaggtgtgtgtcaccatgaccatcagaatttttttattgtatatgagcccttggcctttatgtatgtgtgtgcatgcctgttgcccaagaaggtcagaagagggtgttgggtccccagaatttgagccatccctggctgagttactctgccactgagccatctttccggcccctcgtttattgctctgtcatgtgtgttgtcagggtgtcagactctagagggagttggaccactggacatgtctgcattggggtgggcagcagagtccctggctgggatccggggccatgtaagtggaggcaggaggctgggcagcaggcagccatcgcttccttccctctgaccatggctggtgtgacagctgctattgagaattttatcactgaatcaggaggagcatccgggaccctcagcccttgggagttgacccgtgttttgtgttgagatcactcgagcacacgagcactcgagacctgctgagcccgctcttcccattaggaaggggtcactgctgagctcttccgttttggagacatcactaccatggttgcctatgattgtggtctccagcctacagatttaggtatttggaaatcaggaccacagttttggcttttgttttgtttgatttttttccccttcctattatactgtctctcagattttcaccatgttcaccccaggtatttggagcccaggggatccgaatggatggctgcaatggtcatgtggttatttcttgcatcaaatatactgaacatggacaagcaatacaggggcagatacagcatcttttttgtttgttttgttttgaggtggagtagtccaggctggccttgaactcaccatctatctgtctctgcctcctgagtgttgggactcatgacaattaaatacctcatcaagccaggcatggttgtaccaagctttcttttgggccacaaatcagctcccaaatcatgacatggggacttattcttagttatgaatgcttggccttatcttagatcttactttgatctgtttatctagggctttttttttttttacctttctttctttcttgctttctttctttctttcttggtttctttctttctttttttctttctgtggttctttctttcttttttttttttttggtctttcgagacagggtttctttgtggctttggcgcctgtcctggcactagctctggagaccaggctggcctcgaactcacagagatccacctgcctctgcctcctgagtgctgggattaaaggcatgcgccaccaacgcccctgtgtttctttctttcgctgcttcctgtgcctggcttctggtcccaggagtgtctctctctccctcattctatcttcctttccccttctcttttggtcttctcaagcctagatttcccctatttattctccctgcctgtcatccctgcctacctttctctgcctacctatttgctgttcagctccttattagaccaattaggaaccttaggcaggcacagtgaaacaactacacatcttttcaattaaacaaatgcaacataaataaaagtaacacatcttttttttttttttttttttttttttgagacagggtttctctgtgtagcttttggagcctgtcctggcactcgctctgtagaccaggctggcctcgaacttaccgagatctgcctgcctctgcctcctgagtgctgggattaaaggtgcttgccaccaacgcccagcttacatcattaaacaaacgcagcataaacaaatgtaacacaccttcacatagttacagtaatattctacagcataaacaaaagtaacacatctttaaatggttaaccattccacaacatgtggtggcttgtgcctgctgccctagtactgtcaagggaaagacaggaaggcccggaaatcaagaccatcttgtctacctagtaagatggaggtcagcctgggctacatgagaccccgtctcaaaaatccaaagccaactacaataagaattgccttctccagacacgtcattgacttcctcatgaattacactagctagaatgtttcacaaaacactaatgaagaagcatctgttttaatgaaacagtttaatgaacagtttaaaacagtttaatgaaactgttttaagtaggtatttgaaaaggatgttatagagtgcattaagactgtccccaaatactaaaagatattcatgtctcaaactaggcttacaaagggtgtctagaaagtacccagagccttagtcacactgctccgtttgtttctcagactgccttttcaaggtctgccccatgaatcgatactctgcccagaagcaatattggaaagccaagcaggcgaagcaaggaaaccacacagaggctgccctgctgaagaagcttcaggtaagtcgctgccctctttctccgaggctcgcccctgaggctggcccgagagcaacaataacaagcaggcaccgggccgctcgccttgctgatttcaccattgtgtagagatttcagttagagctcaggcagagtgcagaggtaagtagttttccgttgtagggcgtacctacttatttcctggcatgtgggcaacacatccccactgttattttttaaggtgtgccgggctaattctcaacttctcaccaaaccaaaaaggaattaaaaaaaccctgactgttaaatctaattatattttaccctttatagtactttttcccccctaacagtctatagagaaaaaataatatatatatatagtttgactgagtctgaatttgataatactaagttttgtatcatttaaatcctaggtactctcaggactgaaagctatattttgaggttttaatttacctgcttttctaacagtttcacatcatactgtagagaagtttctagttccacagaaccttctacttaactgaaatttgcagtatagaaacaaatggtccaagacaggtttggctgtattcagcatagattgtaaagttgctgccacacttggggtggggtggcttgggggagatctgggagcctagtgtaaatgtacccccaattacaaaaaacttccttgctggacatggtggtatgtgcattaaccccagcactatgcaggcagaggcaggcaggtctctgagcttgagtctagctgagcctacagagtaagttccgggacagccagggctacacagagaaaccgtctgaaatccagctctctaataacacagcctgtctgctttattcttgttactaagtctctgcttgctatgcttccacactgaatacttggtcgtcctcttgcagcatgctgctgagctggagcagaaacagaatgagtcggagaacaagaaactgttgggagaaatcgtgaaatacagcaacgttatacaagtaagtcttcattttgtcatcagagagggaagtcctttatgggtgagccgtcaaactacccacatgtcaagctgtatgaagcatttgtgataccgtgttcttctttggaggggatgatgattagtctgaggctttcagtgaacatgcatcatatcatgtatgtattgaatacatcttgtgccaggcccaatggcgctggcctgcaagtcccgaacataggcgatccgtgcaggcactcggaaaactgatctcttggtgggagcttaagttaccaaaggtaagactgtgcaggagggtttgtaaggcccagaagacatagtcctttaggtggatgggctgatgcttgatgatttcccggggtcaaggggaaagttttcgtattgtacatttatttaacaggcaatattgctttggcttccagtcctcattgtcagggtgcacattgacttatctcaactgcacccccccttcattcagatcttttaggcttcttttgtttgtttgtttgctagcaagtgccccaccttgtttcaaagaagaatgtgaggccttttccaagaaacacacagcacattggtagataaagcaccagttgccaagggaggcagctgggtggaagggaaaataatggtggctggacgaggtgaagtaaaaaatgaggcttgcttacaaagctcagtaaaacccagccaagacaccgctgtcactgtgaccccagcccaaggcactgctgtcactgtgaccccagcccaaggcattgctgtcactgtgaccccagcccaaggcattgctgtcactgtgaccccagcccaaggcactgctgtcactgtgaccccagcccaaggcactgctgtcactgtgaccccagcccaaggcattgctgtcactgtgaccccagcccaaggcattgctgtcactgtgaccccagcccaaagcattgctgtcactgtgaccccagcccaaagcattgctgtcactgtgaccccagcccaaagcattgctgtcactgtgaccccagcccaagacaccgctgtcactgtgaccccagcccaagacaccgctgtcactgtgaccccagcccaagacaccgctgtcactgtgaccccagcccaagacaccactgtcactgtgaccccagcccaaggcattgctgtcactgtgaccccagcccaaggcactgctgctgctgcttggccacaggagggaccctgctagagccccggtagtggaggtctgtagcatagagcccatctggggactggaagcacattcattcccagaagtgagatcaggaaaatgtttcccttgagtgctcataaagaagacactgtttaaaatggtaaacaccaccctgcacaggttccttacagtaatcaccacaatgaggcacttaacaaggccacattaaagaataatgtctcctggtgttctgtcatggacaaatggcagtgtgccagagggcagggcaaagctgttccccacaggacagggtggagggcgtgactttcggcttggtgggactgcacatcccctaagtagacttccagagatgatgtctcttcactgagctttggtgactcatttaagctccttgtcaagtacttcaagtacaatgcttgtcttacttaggggctgcgttctgtgctttgacatggatcctggaggtacatactaaggcttgagggtgtgtgtgtgcaggtatgcatgtgtgtgcatgtgtttatgtgtgtgtatgcctgggtatgtatgcatgtgtgcatgtatgcatatgtgtgcatgtgtgtgtatgcatgtgtgtgcatacatatgcatgtctgtgcatacgtgtgtgcatgtatgcatatgtatgcatgtgtgtgcatgtgtgtgcatgcatgcatgtgcatgtctgtgtgcatacatgtgtgtgcatgtgcatgtctgtgtgcatacgtgtgtgtgcatgcgtgtgtttgtgtgtgtgtgtgtgtgtgtgtgtgtgatgtgtgtgtgtgtgtgtgtgtgtgtgtgtgtgtaagcctgaagtcagcctcatctcaggtgttgttcttaggagctgccccatggtgtttttggagactaggtctctcacagcctggacttgtggatccagctaggcaggctgccagggagcccagggatacacttcccgagtgctggggttacaagtgtgtgcctcctcatcctgctttcggttttgattttttaacttgggggattgaacttgggccctcaggcttgtaaggcagcacttgaccagttgagctagttcccagacccatggtttttcatgccttcattagtacaataagaaccaagggtagggcctggagttttacaaaaagataattcttgttttttcaattaaaaaattgccattttactttgaaataacttctgcctcatcttatgggtactaaaatgtcccttctcttttggctgattttgaaactagatgggaagtttgcctttgtagttctacccaataaggttatattttgggaagactgtctatggtgtccatggggaagggagaggtgaggaccagtgtgcgttagtactgtcgatgggcagggtgcttagggtgtggcgtaggcctctgattttcttcagcagattctgcttgtgtggctgtaagagtattggaaatgggtgaggttcaggcaccctccggcttttttggaaagcctgattttagtctgctatttctcagtggatgaaggtgtcttcagtgtcccctggggtatcttccacacacagtcaccatcacccttgaagcagaacttggggtggagacgaggaggagacaggcaggcaggttggcaagttggaggttgctgagccttaaagtagctcccgtgtttagtttccagcatgagttgtggtgtgtggatttatgaatgcagctacctgaggagaccacagatacaggctctaacactcacctttcctctgcagctactgcatataaagagcaacaagtacctgactgtcaacaagaggttgcctgctctgctggagaagaatgccatgcgcgtgtccttggatgccgcagggaacgaagggtcctggttctacatccatcccttctggaagctgagaagcgagggtgataatgtatgtgtgggcaaaaccaagggagaagcaaacaacccacggtgtgctagagaactccgaaagtacagtcttcagccagttaactctaaactacttaagttagcatagggaatgatgggctgcattatggcggttttacatatatgtgtcattcattgcactttctaacacgtttggcgttagcattgttttactaggttaagtgcatttgtttacaatataggccacgctcagaaatcacaggacagttaatcaagttagcagagagccatggcaatgttctgttcagtatcttcacagacaacttcttacagtgttgtcacagtgtgcagggtttgagggacatctgcccactgtcaatgacaataaactggggtgtataaatggctgtgatgtcgccagagcttagatcagcggttctcaaccttcctaatgctgtgaccctttaataagttcctcatgttatggtgaccccaaccataaaatcattttcgttgttgctccataactgtaattttgctactgttatgaatcataatgcaaacacctgtgttttcctatgagatggtcttaggtgacctctgtgaaagggtcattcaagctccaaaggggttgtgagccacaggttgggaaccactggcttagatcttttctgctattttgtggaagagaaaaaaagtgagataattccataggaatcattgcctcatcttctctatttatggagatggctcatcttctctatttatggagatgcttctcactatattcttgcctgacttgtaatatagcataggctgacctcaaactggtattggtcctcctgcctcagcatcagcctactgactgctgggattctagttgtgcattgccacacctggttaacaatttgacatttttgtggtagtccttagctcctggaagatgctcagtaaagacaggtttataagtagaactccacacaaatgccaggtgatcaatacttgccgtgtggaaaagctcatatgaattctgactgaattgaaaatgtaattctcctgccatgtttcacaatcagtacttgggttgcatctttagggtgtttggaggtatttcttatgtgagaattgtcttctttttatagagaatctctttttttccctcagtgaattttaaagtacaaattcaattctacaggacacaagcgccatgatttaattgggttagtaatttttctggtgatgctttccttaggtaaggtctgtgctgcatggcatgcagggatggactggattcttgggaaactagttctcccttcccctgcttacttttgatatgaagtgatgtgtgctggcagcatggcgcgtccttacactggatttgtagttaattacactcaactctcaatcattcaagggctaaaatgtagtttgggaactatccacttctcttgtaatggtgtccccaacccccaactcctctataggtggttcatgaaaaccaaacgtcaaatcaaacaaatcctaactacgctcaaactaaaagagtgtgatgacatggtgaaatgagcctctctctgcctttgggttgctgtgaatttcatggttccctctgctgattcctcctttgactttctctccttgcttgcaagccacttgatagtatcaggagagagttgaatgtaacaactactttagacaattagtttcagcagaaacaaaccttgtctttgtggccgccccacagtgcgttaagttgttcttttctggatgcactccacaaagtcccgctgccacagtcttccaccttcttgctgaaaccgtcactgtgttcgttcacctctatatggctttgtgtgtgatgaacgttgccgaggaaggctggcatgcccacagccttgtgtcagcctcgcacggacctgtatgcaactcttgttttcttggctaggaacaggcagtgttttaaaacatcagactgtagtttattgaaggcagttttgccaatgctgtctctttgagtggtttaattatgactgagtttctgcgtaagtatcttaaatggagaggaaattgcaatgttcagaggaattttaaaattgcagtttggtatttagcaatgagcgaaggagagacttgggttgtgtgtaaccaacaagaagtcctcggggctcaagtggagaatgatgcagatggcagcctggagtgcacgctgttccttgagctaagtgcatgaaggtgcactaggtaggatgcatggtttgggggaaacgggtttacaggtcccttcactgtcagctgtatagaaagtccttcactgctgctaagttactagaaaaaccaccgaggtcactggtgagccgaaaacatgggtatttcatttccacgtgtcctcttcatgtttgagcatttaactcttttcctttttagtcttgacctgagaagacaagggtcctttgccctgatgtagatttagaagcataaagaggtagaattcttgaagtcagtagaaaattctaactcacggtgaggaactctggcaggcagattttgtgatttcacagaatgacaagcctggcatttgtagcagaggcagagatagggcattggtgttttctgattcccactgtgaggttcctcttactgtcccaaatgacactcagagcagggacagccagctgcaggtggcatcgttatcagtgaaatcccatctgcagcgtgacatggtcactgcatagacccaacagaagtctttgggattataagatgtaaaagcaaagggcctcgccctctggttatgcatcaaatagagtttcttagggtccgtcaggcctgaagcctcactcttctgagaataattccaacacatctagtaatgcgaattccccgagattatggactgtttcttatacacacgttttccctagtccctcttcagtgctatctaaaaaatgatatactttattttctgtaaatgagtgtttgctggcatctgtgtttggaaggtgggatgaggtctacaggcctgtcctacaaacagcaggcactcatcccacaaagccaagggcaccttcctgcgctgggttactgaacttgaggcttcttggacacagataggtctctagatgcagcgtgcggcaacacagctcctcaatagtacacatttagggtcatgggaccctgaaaatgtgagcgtgtgttttggttaaggtacatggagatgtcccaagtcccaattgttttctcatttatgtaacaaagcaatctttaattgttctaacatgtaattggtatgaaacatgcaaagggaaggtttttgattttgcttcagagtgggaaagccccacagctgggaaagtagatgccacaaaaccgtcttctaaagaaattaagggtggctggagagacggctcaatggttaagagcactggctgctcttccagaggtcctgagttcaattctcagcaaccacatggtggctcacaaccatctatagtgtgatctgatgacctcttttggcataaaggtgaatatacagatagaaaacacaagcacacacacacacacacacacacacacacacacacacacacacacacgtatataaaataaatcttaaaaagaaaagcaaaaacgaaaaagaactagcacaagtctctccagttactaaaatcacactgttattgccattaagaaaaggtaaattcaattccctcaagtctaattagatataaagatatttgcatgtaaaatagacattgctcttatcacacagatgactataaatacagacttaaatttttttagtactttcccctggaaccctgataattcttattttaaaagaaacacaggctcctacagttttggttttagacatttcaagtaaaagggaaccgaaagctccaggcctgacaaagcatagatttttccaaggttgtgccctgctttgtatttcctgaacccagaggtcagatgcttcataattctgagattcgggatgattagttaagcagacccacagcctttcggtggagggggagcatcgcctttcagtggggagggagcatggagggatgtgttctctgctaccctggtgagattctgaagcttggctagaaggaacatcgtggtagctgccttcactgtgtcagccgcaaggacttttgggaagaaaatcgcctgattctgacctctgagaagccccaggtgacatggagactaacggggactagggtttggcaggcatggaacactgaacacgcttctcagggagaagagtcaagtcacaatctgtagaatgacaggaccgggaggcaggctgctggtgaggactgctggggtgtttccagcctcagagcatcagggtgtgtttctgattcccagatcgtcgtaggagataaagttgttctgatgccggtgaacgctgggcagcccctgcatgccagcaatgtggaactcctggacaacccaggctgcaaagaggtgagtccaggcgggagaggaaggggtgctgattttctctagggggagggaggaagagagtaggacagaggaaggaagacagaaaggagaggagggagagaaggaagagcagagagggggagggagggagggacctgttttttcctttggtgggtcggtgcttgcatatgtggtgagagagtgagcacctgtatggggtgggggcaggaggcatccagacgctgtgtgcctgtggttcctgcaatggtagctctattcaggacccttttgttttttttaaaaaaaaaaaaaggaaaggggagagagagagagagagagagagagggagagagagggagagagagaggggggagggagggagaggggagggagggagggagggaaaggggagggagggagggagagcgtgttgtttcttgattctcttgagcaccatgcaggcagtgttagcacccttgggcatctgtaggtactgcctgtcttgaatggttctttgaagatgttttttattgaggcctacactttgttgtccatagttgtcttttttcttctcctgtttggaatggtgatttttggtacagaacacagagtctactgtcttatgtctttaacatttgtctccaccaataggtgaatgctgtcaattgcaacactagctggaaaatcactttattcatgaaattcagctcctatcgtgaggatgtgttgaaaggggtgagtaagccctccatacaaacctttattctcaagcgccagtaatctgacatgtgctcagagccttcaaggataggcgaaggccctgcagcccagagtgcccaggtcagaaaggaactgcaggacccccagtttcctggtggtggccgctggatggttaccatttcctcacctgtttctccagggtgatgtcgtgagactgtttcatgccgaacaagagaagtttctgacctgtgatgactacgagaaaaaacagcacattttccttcggacgaccttgcgtcagtcagcaacgtcagctactagttctaaagcactctgggaaatagaggtatgtacttttgggggggaggaggtttgctaaatatttatataaaaagataaagatcatcaggctgttggctttgctgttacgggtaacattggtggcatgtctataacatggaataatttttgtgaattaacacataatctctttgtggctgtgaccaatttgaaaggaacatgtcacccattataaagcagaacaaattaatcaaggggttgaaaagagaaaacatttccattgtgaattcatcagtgctgatcagactggaagccatgtgcctctgtggcactgcgtcatgactggcagaggcagagacagatctgtagtgagagctaccagatgcacctgtggcactgaccacacccatttgggcgtgatcacaggtgcgtatgtgagcgtgagcatgtgggatttggcctgggctccaagacaggctgtgctctctcttggttctggtcgggtcacagagagcggcaggacattgatcctcggagctaacttgtgggttatcgggttctcatgtaagtgacttctccctgaataaaattaaatattatcctagtctcatgtatcttaatctgtacatccacacagaacctatagccacggaaaatagcgggtatttttttctttgaatgcatcaaaatcgagatacgcatagctaagcatgctattcaccaggctgaggcaggacagtcacaagtttgagatcagccaggtctcctaagcaagctggaagaatggttgttaagcagctcctggcaagggcttcatgcagtccgtggtgcctggtgtggtgcgggtgttctgccaagaccttcccagttctgcagcctaatgatggtacatattagacagggtctactttatagtccaggctggcccggaactcactgtgcagcacaaagggatcctgaaccttttgtaatccttgtgcctcatcacaccaagtcctgggattttatgtgtgagcctctgtcccctgaccggaaacattgccttttgcagtaagacagtgtttacaggtgtgaggcacgggctctctcaagtgaggtgtgacgtgtcttatgctcactgatgggaagttgtgtttttctcccacattgtgctctcgggggtacatgttagatgggttggcatacacaacaggttactctggctgatgacacctgctggctgccatgtggataccattttgtcactgaaactctccctctctgtaggtggttcaccacgatccgtgccggggcggtgcaggacagtggaacagcctgttcagatttaaacatcttgccactgggaactacttagctgccgaggtgagactgttggttacagtgttgttaggtctctgcctgaaacaacgaaccaggcaacccctttctgtgaaagtcattgcattgtcagggaccattcctgtgatttgaatattgcctgtcatgtctggcttggtgtttttctgtccctccctggccccgctgttatgataaaataccctgacaaaaacctcaggtgagaaaggagttattttggctcatggctaataagatacagaccaccatgtggaagtcagggcagcagaacatgaaccagtcatcgagagctgatgagggcttccgctcagctggttctctcctgttcatacagctcagggaatggtgccgcccacagtggtcaagtctttctacctcagccttctcaggattaaccccccttggccacccacagacccttctctcagctgattatagagctcatcaagttggtcactacgattaatccttacagttagactatgagtcactattgtgtgtttgtatgtgtaatgcatgtatgtttcctgcgtgtgtgtgtgtgtgtgtgtgtgtgtgtgtgtaggatgaatgtgcatttgagggcttgtgtgtggagaccattggtgagcctcatgtctttttgctcaggattccatcccctatgggtttggaggatcttggggttgaagactagatcaagagttaggctcctcaggatagggcggctactggagtaatctctgttattcgccaactacctatagcctgcacgtttagtatgtgtttgtatttcttgcttggcattgttcttgctggttgcagttctagttttctgtgcgttcaagcctgaatgctatgtcattgggcaccgtggtctgcatgggagacagaaccaggaagctttcctcagctctgtatatacatcacagatcccactttttgttttaagctttgtttttaggttgtatgtggaaacttgagaggcccacattgggtgtcagatattgctggagactttgccttgtctgggtcccatttgactggtttctctccacctaccaggtcctcacaactgcttataagataacggctcactgtttgtccaatggcttaggattattactggctagctctctctcttataaaattaaaccatatctactaatctgtgtgtggctgtggcttactccggagatgctctggcatgttacctcctggtggctacatggaatctccttgactccatcttctttctctatctctgtttggatttcctgtctggctgtattctgcctgtctattagccccaacagctttattaatcaaccaataaaagcaacacatatttgtagtatacagaaggacatcccatgtcatcagggtctctcacttttactggagctatctgattaggccaggcaggttggccagagtgtagcatgataaataaaagacccagaaacagatattggggttcaagcttcaagctgaagatcagaaaagcaaagcagccagccactaactcttactctacctcagactgaaaggtgatcctggctccaccaaacctcagactgcaatcccagacggctaggctctcctcagcatggctggaaaatcctaagactgactactgaagacctgctcctatcttttatatctccttagtgctagaattaaaggcatgagctttgttattctttcagactgattcaatctcctgtagccctgggtggccttgaactcagagagattcatccacctttgtctctcgagtcctgggattaaagatgtgtgccaccactgcctgatctctatagcttgaggctgactttgctttctgaatcctcaggtggtaagctttaataaatcataaataacatatcaccacccagagaaactgacagaggtaccacattgatgaagaaagtcattcagctcattaattagttagcttaggtgttctgcaaaagcagttgcatgctcttagagccatctctctgccccccacccctagtttattatggttaatctgaggtgctcataacagtttctctgcatttggaaatttggggattgagatggggctgacagtagatttttatctcatcagtcccaggaattggagaggatgatgtgtttagactggaacctccaagaagcctgggagcctgagaagctggggacaactagaaaacccagtgggttgaatcataagtgccaggaagtcagggcagtgtttcaccggggttggggtgaggtgtgcgtgcgtgcgtgcatatcgtgcatgtgtgtatgtgtgtgtgtgtgtgttgcacaggccagggtgtggccatgagtggcttcatgcagagttcttcaggggagcccagctgaagggagggtgggccgagttctcgaatgcccttcaccgggagaagcagcagtgatgaggggaagccctaagtccagtctatgctctgtataaaatggatttaaaaatcagacaggggattgtcctccttttgcatagaagggaagtgcccagcaggggacctggacggccagggttgtgctctctttcccaccctggggaggaatatttatagattaaaacatggatgtgttttagacaatcctggtcaaaagagattacataatcctggagctgcttttgggtttacagtgctaattaggcaaagagagcctataatggtacaaaggattgtcatacctacggccccctgtgtgtcaggctttaagcagacatttagcctctgtctggacccaagttctcttgtgtgagacccaggcggtcatctgtgttctgaggggttgtgctggaataaagaagacaggaatgtacagcaccatgttcacaaaaagtctgggagatttgaagtgcctctcctctgtggagagtcaggagagaaggcggagagcagcatcctgtccccatgagcatcaatgtccttgcaaccagctagtgtgtagttgtttatgtgtttgttcatccatctgtgcattgtgtatgtgcattgtgtatatgcctgtcagtgtggatggtgtctctacagtgtggacagtgtctctgcagtgtggacagtgtgtctctgcagtgtggtcagtgtgtctctacaatatggacagtgtgtctctacagtgtgaacagtgtgtctctacagtgtggacagtgtctctacagtgtagatggtgtctctacagtgtggactgtctctcacactacccagctctccactgtgaacagtgtattacactacttggctctgtacagtgtggacggtgtctctacagcatggacagtgactctacagtgtggacagtgtgtctctacagtgtggacagtgtgtctctacagtgtggacggtgtctctgcagtgtggacagtgtgtctctacagcgtggacagtgactcacactgaatttgcactcaccagagactaggttgctgactggataggaactatggctgctgcaaatacagtggtttcctttcatagagaaggttatatagaacctttctctgagaggttatataaacaagaaaccttaaacagataaaaaaataatgtaacaactgtgttcaggctggatgctgcttttggactactgcactgtgtaatttgtcagtggtttggacaatatctggagatggttggctgacatacttgggaagggggctgggatctgccgctagacctcatggatggctaaggcagagggccattttctcctctgctgacagaattatctggtcccaaacacaaagcatccagaggccaagaaaccttgctctacctcagtctgacatgaaacagtcacttactgaatgcctccatgtggaagagctctagagaggcacagatgttaactgtggttgctgtctgctaagtgcctgccgtctgtgggggactgtacagcgcaccaccgagccatatatcggctcttactgtgttgattgctcccatcagatacatctgagacctctggctttagtaaatgtttaaattaccaacatctaggtgtgcacactaaaatcagcaagtttaaagatggcaactttaagagcagaaaagagaaagaaactctgcagcattatttgtgaacatagtgctcagtgcaactcttttaaccagcatttcacaaggaaatgaagttatccagataatcgtggtgagcataagattcgtgcggaacagcagaggccacaagtcaagggaagccgggtgttccgtaggctgagactctatagtgaattatgcagccagcatgcacagttgtaaaccgctgacgaataggatctctgtaaaagattggctgaatgtagaaaacataacgacttagggcagcactgaaggatgtaattgggttttactctgcaagaccacagagtaagccaaggtttagaagaccccccactcacccaccaccccacccccggccatgcagttttacatagtgtggattaattttcaggaaatacgcagggccataaaactgtggttgaaatctatatctatgtatttaattacagatcagataataaagacacgtggacttcatgtggttacacaggcatgtcactgggctctcagtaagtcccttccacggggcatacatgagttaggtggccagtgtggggatagatttcgggcagcacagctgtgggctcactgatgttgtgacttagatcttttatgcccttgtgacaggggtcatcttagaaacaggctagcatgggccttagaatcatctcccatcatgtgggaagggccactccatcacagcttccagcctgctgcttcctacattttctcaccgtggagattaaccactaaagcaaatgacgtgataattctttcccaaacaagacaaatcagagaatgtaagataattttatttgttaaagattccatattaccaagccaggcggtgatggcgcacacctttaatcccagcactcggaaggcagaggcaggcagatctctgtgagttcgagaccagcctggtctacaagagctagttccaggacagcctccaaagccatagagaaaccctgtctcgaaaaacaaaacaaaacaaaacaaaacaaaattccataatacctttggttttgcaagacagggtctcattctgtctgggctggaactcactgtgtttcagaggctggcttcgagttcctcatatcctgtctccccctcccaagtgcactctgccatgcctggctttggtagcatctttagagagtggctcacccagggcttggcggtgtgggtggggggggggggggttccctgggtaagctgcttgtcgggaaagcaagaggccctgagtttgtcctcgggtacatgcctaaaaagagccaggcatggtggcttgtgcttgtaatcccagcagacaactaggagggttctaagccagtgacactgtgtcaacaacaacaaaaggtgactggtgcctgaaaaaccgtgcatgtgcgcacacacacacacacacacacacacacacacacacacacacacacacacacacacacacacgctgaagaaaatgaactagcatatttgtttgtagataggacaagcttccaccagatggcactaagcacttcctaacttcgcagttaggtgcagttaattaaaaacttaatactagcaaagaggtcaggcttggcatctcacagttgtgtcccagcactcccagagggggacgcaggaggttcagaagctcaccccgccccccagcgactgtatagtgagtctgaggccagcctaaacttcaggagacattttctcaaacaaagaaacaccaaccaaaacaaacaaacaaacaaacaaacaaacaactcaaaccaaaacaaccagggaaatttgggggggggggatggttcagcccattaaggtgcttgcttccaaactgtggacctattgctctgcagttctgttgggtctcagcgcccatgtctccagaggatctggtgccctcttctggtctcaatgagaattgcacttatgtgcacaaactcatgagtgtgttccccactgcgcccccaaccaaaaaaaaaaaaaaaaaaaaagcaagaatatgagcacgtgttctgggcttctgtgatttcagtctgtttcttactgttgtgtggatgaaacactgagggcattttgcagctggcattgggactgttgactctttgcaatgatctgactcctctcctccacgttgcggtcgtgtttaactgtcttcaacagttgacgaagacgggtgttttttgatattgccagtaatctatgttcttctccttttgaggttcccatggctctgtggaccatgggtgtgatcttgcccatctcactgccttaaaagtgtagcaaatattattaaagcttgggttattttgccataacgcagtgatttctctcctagttcagggttagcatttgagaatcaagcatatctttctgtcgcagtttctatacttagatgctgctgaatgcaagcctataagattgactttatagcattcatttaaaagccttgtttgtcttgagtgatcttccttttagcttaaaatcctcgtggtctaggccctagacctagggtgatcttccttccaacataagggcctatccagtgtggaacccttctgttttgtttcacacactctgcttcctggaggcaggagagccagatgcagcagttactcagggtgtggattccatccctcagacatgtgccctcaccctgacacggcgtgggtgtgaccgcgtgaagtccctcatgcagtgcgcccagtgaagtagaatcgagagtattcctgagaagcagaattgtgaggctaagtggataaactctccaaacatatcttaaaagtatcacagagagactctgcaaataagtcccgagggtgcgggtgttccttctcctttacctgccacttaaaattcagtcccgagttcaaggattgctcagacccttgaacaattcttgaataagctagcgcatcacagactcctccctccctctctcctctgacccgtgttatttacaagtcattcatttctgcctcctagctcccatcacatctgcatcatggtatagctgaccacatttatgtcttattttccttcctaggccacagggtcagtggccagggacgggactcttggctaaaataccactcgacacaagtttgccccttagagatgctctatcaattacaagagttctctctctcccttgtgccagatttataattcagtttttaacataatgctgtattttccttcaaagtattaaaatatccagggacttccctagccatcattttcttccttctttagcaatatctttttctgtaatcctttgccgataactttgataaatacggctgttgctctatttggagaagggacaaagcggtagaatttgaggctgtgagtttatttgggtgttttcccttctctgtagtgacaaaacaactcgagagagggaatatatatatatatatatatatatatatatatatatatatataaacacagataatcataaagggttaatgacatttcagtgaaaatcaaacacaagtacaaaaccaacatccatgtcagcgtccactaaagcacagcagatgaaaacgcctccctcgcctggtacttaagcattttcacctgtgtgtgggcatgtgtgtgtgtgtatgtgcacacatatgtgtgtgggcatgtgtgtgtgtgtatgggcatgcatgtgtatatatgcgtgtaaatgtgtgtgtgtatgggcatgtatgtgtgggggcatgtgtgtgtgtgggcgtgtgtgtgtgtgtgtgtgtgtttacattcgtgtatatgtgtgtgtgagcatgtgtgtatgcgcatgtgtgtgtgggcgtatgtgggggcatgtgtgtgtatacatgtgtgtttatgtgtgtgtgtgggcatgtgtatgtatacatgtgtgtatgtgtgtgtgtgggcatgcgtgtgtacacatgtgtgtatatgtgggggggcatgtgtgtgtacacatgcgtgtatatgtgtgtgtggggggcatgtgtgtgtgggcatgtgtgtatgtgtgtgtgcgtacatgtgtgtgcatgagcatgcaggtgaatgcagggattgaactcaagccatcgtcactgtaactttttacttaacactagttttgctttgtctttcagcttaaccctgactatcgagatgctcaaaacgagggaaagactgtggtgagtagaagtccccgcagactgtcccaagcgtttcacaccctggtttacataaataagtcagagccttagtaaccagcttgagtgctgtggcccccaggacagagcctctcaactgaagggatggtgtgagaaagaggggcgcccaggggatctctgtccagcagggggcgctaagggacctcttgaagactggttattgaaaggcattgaggcttctgtagtaggtctaggtccagtttccagaagtacataagatgttaagataggacaggaagactctccttcttggatttaagatgatttgggatctgcttgaggggagaaattaaaactgcaatccatgtgtcatgggtggtgtcttgatatttttaagtgtccttcaggaatgactgtctctctgtctctccgtctctcccgcctccaatctgagattaaaggtgtgctccaccactgcctggcgagtgccacactcttaacaccagttttcacaagcgtttttcatgttacacactctgctcatcccctctctgtagcaggggtgtgggggacagtagggttagctttatttaaccaaagttcggaaactcgggggaagtagatgtagacaaacctctgggttagacacactttgagtgtgtgtacaaggtggcagatgttacttcatcatttaaaactctgtccttaggtgggcagtggtggcacacgcctttattcccgtcacttgggatgcagaggcagatggtctacaagagctagttcccggataggcgccaaagccacagggaagccctgtctcaagaaaacaaaaaacaaaaaacaaaaaacaaaacaaaacaaaaaaccccctctgtccttgtgttacacagtgttggtcaggcaggaggaggacatgttgacactgtcaccagggatctgttaataggtctgatttggttgtcagtgaagaccactttgcacctgccattatgtacagtcataactgtaattagtcaaataaacaaaaacagacccaaaagcaaaagttaaaataacaaacaagtcagtatcacccccctcccacggccagccgtctgccggtctgtccatctatctgtcttcttggagaagtgtctctttagaatgttttttgggttgtttattcttttgctgttgctttgagctaaaaagagtcacttctgggcgttcactcctcgtgaggtgtacacattcctccccttttccgaggcgtctctgcctctgtccctcatccctctgttttatggcttggtgtaatcccatgcatctgtgctttttgtcccctgcactgtctaaaacatcctcacacagacagtatcatgttgcgtttctttctttcttcttctttttttttttcttgtcaggaaaatgaaaatcaaaaccacattgtaacatcttctcaccccagctagaatgaccattgtcaaaaagacaacacaacagattctggcaaggccatggagaaagaggcctcctacaaagctggtggggtggatagtcggtgtgaatacagtgtggtaattcctcagaacttaagtgcggaattgcagtccaacccagcagacccactattgagtaacaaccctccgcagataaaagctagtatcgaccctcagctttcatgcctgattccctaaagcatttttcacaccagctgagacgtggaactagcctgtgtccacccacagctaagtgggttacaagtgtgcaccagtgcatctgttttatgtggcatggggcatggaacccagggccttgtacatgataggcaagtgtcctaccgtcccagcctcagccccagccccaagtgcctgatttaaatggtggcagtgtttgcctgactccccaggttcgtagtctatttttgtatggcttagtaggtccagcaagaacttctggacttggggggctggagaggtggcaatgctcttccaaaggtcctgagttcaattcccagcaagaacactgtatatatacataatcaataaataaatcttaaaaaaaaagagcttctgggcttgactcaatcccgttggacccctctttctattttattgtcagggtttaagtaggagtggagccggggggggggggcgggtcaggctgctggcccagtggaagttcactctgtgttcaaacatctctagatacaggtgggcttacttgattggttaggcctgtttatatttatacttgttttgagtgaggctgaagttttggttctggccagaggaggagttcacatgctactttttgtgtctagagtgtattactatcatgtctgggccgcttcttcagcaggcccacttgtggacattctggagagacctgctttccttgctgtctagtgggctggtgtctgcctgcccacctcaccttgtactccaagaaccaagacaggtcaaaaaaggtgttagtaggtttaaaaaaaaatacaagtagctggacctgtggtgcagacctgtcttccaagttactcagtggctgaggcaggaggaagggagaggggctgagagagccgatctgcgaccatgctgattattttccttaattttccctgtgtgttggcgacttaatgacctgctaatttttttccctgtaattcagaaatctttatcaaacaccgccttctatatttgaactttcagaggttaatgcatggtgtcgctgagatgagatggtgtgtgtgtcagggctcccattaagaccaaattgccgtgttcattttgcaaaggggcctgttatttccagtcttacaaatgcacagcttctctgggtacccggcaaacattggtaccttgtcaagcccagccgggtacctcacggtcattatttcttcttgaaagcccacatcttttcagacagctctgcagaggggattttttttttttctgcaatgtcattcatgttagggggacattgccgtgtatatgtggcatgggacctgatccttttgaaggagcgtctgtcatggaggcttgagggggacgtttcatggtgtctgcaatgctgacacacagcactagataattcttggtggtggtagtgggggatcttcggtgtgagtggtgggctgtcacctgcatgggttgtagtgggtgctccctgcatggtagtggggtaccctctggatggtagggtgatgggcagcatcattgatctcatcttattggggtgctagcagcaaccacacccctgccccagctctcagttgtgacaaccaaaaaaaaaaaaaatgtgttcagaaattgctagatgtcctctgattgtcaaaaccctcctgtgtggcaaaccacagacccgagtgcatttatatccttggggatgttctagagctggagtctgttgacacagtactttcaaattctgttctgtagagtttggagatggggagtcaggtgccagcagacctccacactgctttgggttttattccaggctcactggcagtaaggggtgcaggctgggcaagcagaaggggtcccgctctggggaggaggcttacagagatagcgtgcttgccacttccctaggcagcctggagtgtgtggcttccccaaggcagaactgggagggtggggatggggtgggtgggcagggatgccagtgacaggcgacacagcaacctcctgcagcctgaacctcagctcctcccagcatgtctcaggctccaacagtaccggcaatgtgaagtttgacctaaaatttggtgactcactatgagtcaccacaaaggtattctggggtgtcccgaagtgcacctcccgggaggtgccattagcttctttgtagctttgcataagggcaggtttctccctgtgtagccctggaaatctgtgccatctggggccgagaagacagctcagtcggttgagtgcttgctttgtaagcatgaagtcctaagttcaaccccagcacccacttacagtagctgccagtggcggtgccgtcctgtaaccccagcactggggaggcagaggctcaggcaggctcctggtggttgctgggcagtctgcctccaagtcccggtgagaccttgtctcaaaaactgaggtccaagattgatctctgatacacacacacacacacacacacacacacacacacacacacacacacagacacccctctgcacccagacatgaggacatgcacagccactcccatgtgtacgcgcatgcccacacatgtacaaacttatctgaagcgtacctgtctgacaagtacccaggggacaggaggcctgggacctgagctcctaagctgggcattcgtcagagagagcttgctggtgttccattagacacctgtttaagctccatgacgaaaggcaaactattgtgcttctgaaatcccctgcagggagctacagttgctgtctttctcttcccttagaaataagtgtgggtttataaacagaatccacaaagtccgtgagtttgaacagagttgtcatcattttgttaagatacagggtttcctttcttgtctattgaagctacgtccactattatatatgtaactagaatttttgggtggctctggcagtcctgacggccaggcttgacgtcctgatgtaccagttagagagagaattgattgtgaggagcagagaggggaaacggttttagggtggccacagaggaagaggagcagatgaggggccagtgagctcgtctgtcttcagggtcctggctcgagctctcggtttaaccagagtaagcctgggccccgactatgagccctggtcaaggctccatctggttacagctctctcacaccaggctgcacaggccgtgtgaagttaccgctgccaccttcacttgactggatcaatgggttcccccagagtgatcacttctgctcagggtacagcctctacccattgaggatttctcttcttggattcaaggtgactgcaggctgaggacaatgacttctccaagggcattgagatgggggaggaagacagacacttgtcagatccccttcctacactcagggtcagtctggcttctgagacaaagtgaaggagggcagagaagccaggcttccaccctgcctctcgccagcctgtgtggcgtctgcatagaagaacgttttccaggtgtcttgtatgttcataactcattattcatatttaattacttaaaaatgccaaggggcaggcttaatgtttacttccaaactgtttatgaagcagagtctgttaaataaattagagtgtgggaagccaaagcaggaagcttcagacagcagggccctcgtaaaagatatgtaggcacatcggaagtcttccacacacagttgtgaaatgatttatgtgcaggaattttcttcatattaaaactattttccaaagaccagtgggaaggatggggaaatacaatagcacattccatgtgttctgtctgtgtagttacaaatcttgaattctgtggataattagcagtggcttgttttaattaagcctaatcagtgagtttttaaaaataggtgtgttggaaagagtcattgcagtgcaatcgtcacagtgcagggagacccctgaccactctgattgggccccttaggcagacattaccaaggagaaccatataggaggccatctctaggaatctagatctgaaatcttcttgtaaatttaccaaagtcatctcaaagttggggtgaacagagggctgaatcccactaaatgtacagaccacacaaatgctgtcaactttcagatcctaaatagatctaaatagctgtatcagttagcacattttccccctggagtggtgtgtatcaaaagataaattataaggtaaggggcaggaaggctgagctaggaaatcagatggcatacttcttttagggagacagtatttttccaagaatgctggcaacttctttggtcttctaccagacactgttggaaccctgaacactggccctccaattgttgaggttgtgaaaccctcttctgccaataaagcttgtcttcaaaacatggttcactgcaaccaataggaacttacttccctgagctcagttgtgtttcaattataaccttccctatctgcccaaaccacttaagccctgcggtagtgcgagctgcccatgttccatgtgttggaaacttgatcctcagtgttgcagtggggttgggttccctcggaggaagtgggcatgagagacctcgctcatggattcctgggctggtctagggttggtgtggcttgtggcagaaccaagcctgctgggactcagttgctctggctcatagtgtggtattctccatgtcatgacgcagcaccagggccttcaacagctgtctgtctgtctgtctttggctgtttacaaggatagctttttggtttgttctgcagccagcctggggcacgggtctctgtgaggtagggactgactgtggtttttgctcaggcctctctgtgaggtagggactgtggttttttgctcaggcctctctgtgaggtagggattgtgatttttgtatttgaatgtgatcctgcatggttctcacatcctcatgcccacagggagagtccctgggtcacatgttttcataatggcataccatccacagggtgggtacaagggttccctttctctgcacctttggccgtttatcactggaccttggtcatgctgtccttagaagtgtgctgcctgcagcagttttgatttacattccccctgtaactagtgggacctatatgcatcggtcatttgtgtgtcttcttgagtccatggaatttagaggatttgggacgctgcttcttctctatgtttgatataaatgcagagggtacgaaaccactagagaaggggccataacgattgtgatttaaggacatgctcagattagaagacccctctggggagcatggaccgtatgactgcccataatcgttacaaaggctatgtgcctgatcttctgggggattcagagtagacactcctataacccaatggaagaacgcaaactcacaccttatctccggattgactggagcagctaacactaaatctgaagacaccgaataaccttgagcctcttcaacagagagatggagagcttccaacctcaaagaagaaacgccagactggggagaagattatgtacacgctagtctcagtaccacacggaaatgacatcgcatcccttttcgaacttgatgccacaactcttcagagagctgactgcctggttccaaggtaaaaagaaatagaaaataaaaggaaataagtaagtaaaaggaattggggtgaacagatgcttctttgaatagtcctcccaacaggaagaaataaaaaagtataattacaattttacaacagaagggagcatgagtggagaaaatgcatgcaaagctctgtgcctctgtcaggtgagctcatcaacacaacttattttatttgtatagataactaaaatgtgcagtaccaaagacatcctgaaaaaagtattagagtcatttattcttattaattgtgtggcctttggtcacgacaacgaaaaaaaataatctaatagcatttttagtctaaattttatcatttacctgtcagatttcctgcctagctcatttatatgctcattcttttagtggttcagctaagaagtatttgttgattgtcaattaccaggcagaccacgcccctggcatcaaaatgagacatgggtcatcaatcagagcaataaacacattagctcaggtgactcttgaacttgtggttcacagccagtgccccaagttgggtccagccacctgtgctcattaagccaattaaaagacccaaattaaaaacagaaagctgaaaaaggagatttatttggtgtagccataccagaaagggatatgaagagacctgaaaaccccctgttgcgtgtctgtctctccctcctccttgctcgataatgtagcccctgaagacatacattctgctgctttggcctgagccaagtgtctgtccttttgtatggtgtcttagttggggtttctatcactgtgaagagacaccatgaccacagcaactcttataaaggaaagcaactcattgggcctggcttacaatttcagaggtttagcctgttatcatcatgacaggtggcttgtaggcaggcatgttgctgaagaaggagctgagaggtctacatcttgatctataggcaacaggaagtgaaccgagtaccacactgggcacagcttgagcatataagacatcaaagcccgcctccacattgacacacttcctccaacaaggccacacccactccaaaaaggccacacctactccaataagccacacctcctaatagtgccactctgtgtgggggccattttctttctaaccacaacctatgggaccctgattattactctgacttaactcattttaggtctaagcaaaaatgggtatctttcttgaactcagtgtaggagaatttgcctgaggaagtagtgagaagaactcaccgtcaggtgcatgcacccaccacaaggttgctatgtctcacattgcacaggggtgttagctgctgctgttcagaagggctgaggttctttgccccgttgtgaagggttttgtgttgaagcattcagctgctgttcacggtttatagctaacaataaacctttaacgctagccacttttacatcctcatataaaatcctccagtgctttctatgtgccaagccccatgagttcttcaaggccattatctgggttcaccctgggtaactctcatgggtcagaggtcagaggtcagaggctgagttagagcaagtcttctcagactggctgagaaagatctgagcaatgggtcctggcccttctgagagtgaagaagtcagtctttcagtgagatatggacaccccatcttttaaaagcattatccagggggctccaatatgaaatgcagcatttccccaaactttaaattcttaccgtgtgatcttttcctggagggatgtgtacaaatgtttccaaacacagggcaccacaatagatcaaaggaaagattccattcaagtccagtgagtgaaccagtgagtctgttgggtttacttactggagcttagtgaggggttcttacgggaatgtgggtgatcccaaacagctgtgtcactgaaaggcttgactccagcatggatgacaatgtccggatgccggacagatggcaccccctctttagctgacgtttccctgccgtgcattctagaacttgatgagactatacatagttgggaaacgcaggaagaagtgtatttactacccttctacccttcctaccctcccccacgagggaacatcaacaggcccaatcctgggggacagtcacacctgtcctgagtaagatggcaatggcctttatgctcagaggtcagagttccacagtggtgctttagcctggtgagccccaagtcagccttggggatctgatagagacacagatggtgagtccttggtccatggtggggctgggagagagagagattttccagcaagccacggactgcactgtttggatcaagggccttgagcagggctcccaatctttcccgcccaatggacacttagcaatctgtgaccagtcctgatgcctacctctcactctaggcactgatttaactgatgtgtgttataacctaggctttgggtttgttagaacttcccaggtgacagacagcagagtttgggacaagctaactgacctaactgtctgtgctcatgaagtgcagtttgaccctggagtatggtttgtaaagtctgccctgaactaccattcctcagcagcagccttgcactgtagacaaccagaccatgtcacacctgactgccagcacacatctgtgacatggtcccagggttatttagttcctaaatccttgcagatcatgttattattctgggtcttcttctcagtttgcagcccagtagtgttgatggttgactcaaggggttcatccatgctgaaagcatccctgatctgaaaatctaatctgaaatgacccaagaagtgacagcttttgagaagtgatatgacggcacaagtggaaaatcctgcacctgactttgtgtgatgggttgtagctaaaatgcaggtgtacttaaaatattgtataaaattacgtttggcctcaatggctaaggcacatatggaatataaatgaatgtcatgtctagacttgggtctcattctaaaagagctcattaaacgcctacactgaaatgcttaaaaaataaaatagttgcttttctattgctgtgaagggacaccgagaccaaggcaacctgtagaagaaagcatttaacttggagattcatggttccagagcattagagttcatgaccaggaggtggggaacatggccacaggcaggcgtgtgcatagcaatagccgagagcttacatgttgagcaataactactaggcagagagatgggaaggagagagacccaactataatggggcaagacttttggaacctcaagctgacccctgtgacacacctcctctaacaaggccaccagctaggaaccaagcattcaaacatatgagcccatggaagccatgcaatgtttaaaccgccacaccagcattttgaagaagggaaactcacctgtgttgaaacatgtaaggattgaatggaggagctggccaccacatagtgtgctgtggccccatttttccagagtgtaggacagcaggggagacagcagctgtagatgtctcctgcttaggtcagtgcagaggatgctgggtgctaaagtagaggcttttctggttatttggacaagggttaggtgctggccattctagatattgaaactcagtgtgtattttatctacctttatgaatgagcaatgttgttggtcttttactctttgctttttgggctcttggggaggggcttgctacccagctcccccagaaaatcacacagagatatttttcttataactgcccagccttactttggcttgtttcttgccagcttttcttaaataatcccacctaccgttttccctctgggcttttatcttcccttcttccgtatatcttaccgtcttactccttggctgaccgtgtggctgagtggctgtcccctgacgtccttctctccttctagtttgcttcttctttttgtatgctcttcctgaaagccactcctgtctttctactgcctcactgttcagctctttattagaccatcaggcgttttagacaggcaaaaaatcatggcttccgacttaaacaaatgcagaataaacagaagccacacgcctttacaccattaaacaaatgctctacagcataaacaaaagcaacacggcttaagataatattccacagcagagcaagaaccttgacgatgagtttccctgaggcgtttagcgtcttgtgttctctttgactctaaaatgtttactttgggttgtatgacatatttatgtcttagctttaggctgaatactaagtgaaaagcctttttattttaatggcaccatgcactcttgttgaagaaataattggattaagagatgaggtgtggagaaggggccgtctgagtggaaccgagctctaggcgccctctccagcatctgccatggcgtctacacagataatttttgttactcgtgactcaaaacatggtcaaatgtgtgactgttgctcttggaggacacagggtgtgagtcctgtgaactcctggttgaaatcacctgccaaccttccagtcagcacacaagcttgtgtgtgtgtttggtagacaccttgattcttcacacaacaaatagtttctttctttcctttttattttattttgtttttaggctggagagatggttcagcggttaagagttcatactgctcttttagaggccctgagttcacttcccagtacccacatagggtggctcacaacctcctgtaactccagctccaggggatccgatgcccccttctggcctctatggacactgcatttaactatgtacacagaatttaaagttttgaaatttaagttagcatacacagtgatggcttcatgatggcgtcttcctgtacatgtcaccagactttgtttgtattcgcctccccaactccactcctttccctgtcaccctggcaattgttttaatcttcttacttagagcccagagtcggtgcttccgaattaaatagcaagaccagaacaaaacccagaaatctgagaagtgtcactaagagaacatggtgtgaagtctgagttagaacctgagcagctgcctgctcagcctcatattggggatgtgcctgtcgggctgctctgaaccacttatctatttaactgctctaggtttgccctcaatgggtacagcagccccatgatttaggggctgtcagtacatttaggttggtagctgtctggggacagaataaactagttactgctgaccgcacccccagtgcaccagtgaggtcttagaatttgcattttgacaaggttcctggtgacactgatggcccaggaagtgatggccgtgggctccagagaagtctgaatctaagaattttcatattccagacaagatcctgagacggttactagtctatgacatttactgttcacaccacacatggatctgctgaatatgtcaatatgcaaagggtgctaattaaacatattattgtctgtgtgtgtaggtcagaggtcagctttgtagagtgggttcttgccttccatcttcagtgggttctgggattgaactcatgtcctcatagttgcgtagcaagcccctttggcctctgagccctcttgccagcctgatggggggaatgtccttctgtatatatgtttttcttactggttgatgaataaaacactgattggtcagggaggaaatataagcagggctaccagacaaggagaattctggggaagaggaaggcagagaggagccaccagggagacaccacatcgtagccgccaaaggagtaacaggtctgggccttctctggtaagataagaccatatagaaatgcatagattaatcgttacaggttagtaattaagagagagctagccaaataaatgcacaagcaatatatcaccacataagccctccatgcctttttatatcatttgcttttaggaactcctatgtgcggctaaggcatttgtgcaccaatacttgggtaacgagcaccagcatccccatcgacacggaggaagagaggcccgtcatgctgaaagtaagtgtgccccgactggttcacctgctgtgcacacgggactgagagtgactgacagtccgtcttgcagggtgctagaactggttgcagctgatttcgtgggagtgaacatctgccagttggttaggtctctgacttgggtggctgcagcagggctgttggaggagggtgggtttgcagacatcaaaaaggtgcaggaggattccaggggcaccttctctgcttggaagtatctgggactgagggacatcgtgtgaaagaaaccctctttgggggctcttcaagaacagggaaggaaagccgggcggtggtggcgcacacctttaatcccagcactcaggaggcagaggcaggcggatctctgtgagtttgagaccagcctggtctacaagatctagttccaggtcagcctgctgaaattacatagccacagagaaaccctgtcttgaaaaaaccttaaaaaaaaagagcagggcaggaattgggcacggaaagccatcgtgtccccgaagcccttcattgtggatggtgttttctggagtttctctgtcttgtccacacccaccccagtggatcttactctgaggactacggtctctagagactgttgctgtttaatggaaacacatattgcagattggaacctgccagactaaggaggacaaagaagcctttgccattgtgtgcgtcccactgtccgaggtccgagacttagacttcgccaatgatgccaacaaagtgctggcaaccacggtcaaaaaactggagaatggcagcatcactcagaatgagaggaggtgagtggaaccaaatgtgacgttgaatcattgagagtcaaccgttggcctgggtgtgggggtgcaggctcacaggttctgtaactgtaggttgaagggacatggcgccctcctctggcctccagaggcactgcacacacatgcacacacacagatacacacacctaaataaaaataaaaaataaaaataaactaaaaatgtcagatggaatacttacttttcccattttatcttggctcaaaaatagatgattttagtttctctctgctctatttttgaaagctttttaaagactcacaggaccatacttgatttggtgtttagatggagagttttatatttcctggattcatgacatattttgcatgtaattaccatgtaatttttttgaaagtgtattctctgcttgtgtcactcagagaaactggaccatcgattggttattcatttatttataaatatgcgagaaatggccatttgtaatagagatcattgtctccacctcgtgccctaagccttcacacagcccttcagtagctattcccatcctgcctaaagcaatgggggttaaactccacctggtaaaattacatgaatcataagtgggggatccagtcatgtgatcgacagttgggtgctcccaggacctcagagcaaagacgtctgccctcttccctcttcatgacctgctgcagactttgatcaataaggagccatttgccacgtgcattccagctgtcacctgcagccatcgaaatggcaagccccccaccaaacggcccagacagaaatgcatggcaaatgtagttgttgttttgtttctaactcttaattctttgctcttttgggggggctgacacccagctcccagataagcagtacatggcgttttattcttacttatgaatggctggccttggcttggcttttttctagccagtttttgttaaactaccttaaattaacccattcaccttttgcctctgggctttgtcctttccccatttttgtgtatcttcctttacttcttactccatgtgtggccggctcctcaagttcttctctcctccatttcttgtttctcaatctgccctcccagatttctcctcctatttattctctctgcctgacagccctgcctatcctttctcctgcctagctattggccgttcagctctttattagaccaatcagatgttttagacaggcaaagtaacacagcttcacagagttaaacaaatgcaaaataaaagaatgcagtccatctttgtgtaattgaacaaatgtcccacagcatagacaaatgtaacacatcttaaaataatattccacagcaggcaaagtcagagaagggagcactgtggctcactggtgtccattccccagctgggcgttctggaacatctatctgttcaatagaatccccagaacagaagggcagaaatgtccagccttgtctacgcacccccaactgaaagccgtcatgtttgctgtagttgaaggatgatatgattgttctgtgctcacacaatgggatagcacatagccagggtcaggaatgaactagaccatgtgtgatggtgtacatgactctgacaagttttggattgagtaagaaggaaacaggatggataaacccaccattacactctgagagtgttctgtcactaaatgtatacattctggagacctttacacacagcccatacaataaagtcaaacattgtcagtgtgctgacagtcaaacggttctcagcctcctctctgtccttactactgcttttcctgtggggagcctgcatttgacaactgcctttagacatctgccctgtggtggccaacaaaccaaggccagaagcagaaaccggccactcgtatggcctcatgtgattagagaccagggccagctcacaacagaaatgttccagtgtgcagatggggtgtttccctcttttgcctcctcttgatgaatccgtttctgtctgtctgtctcctgcattcacagaaagttacacacttctctacgaggtctcctttggtaaactccaagtatctattgagtgctgggcctctctgggtgcttctctctccagggccttctcccccagtgcttgttgggggggactcagcccctctggatatgtcttaggaggacagtggattaggatgacccttgaccctatttttattttttatatcccctgcctctttctctcttcactgctttagtggagaataacagcaaggagactatgcctgagaactgggaagttacatttgctgatccacccttcatcctgatgcagtccgtgctgcagagtggtgaaggggctcttagtctctcagctttagaatttaatagaaaattctttctgagaatgactggcagccttgacacccttccctctcccccatggagagtgaagttattattagctattctttttattcaaaaccaaggtcaaagggagggtttgagaacattgcagacctgcctctgaatgcctgtgatgttggattcccccccccccacacacacaccgtgctatcctttagttgacccaggaagggactctggatgcaactcctgccaggctcagcatcctcagctttcgatgttttcatttgaattttctgtttgtattctacatgactgcaccaagtaagcagagcattagaagtgtgtgccccactcatgacgagggagggccatgaggtgtcagctgctacctggagcctgggaaggcactgagtgcaagtcttacagtctctgtaccacacaggctgcacttctgaaggacctggtttgtccacagagggtccgttgtcacagctgtacacacatgtagctaattccgtgagactgagctcttgttatgtgccaggtgctggccacacagactgtgctccaagtagctgcaaaagccaaggtcattgggctcttgtctaaatgcagctaggggctggggacaaggctcaatggcagagtgtttattcagccagccccacgccatgcgacacttgctgccaaacccagcaccttaagaagaccgccatgccttcaggcaacaaacagagctcaagggctcttaaaactcgtcatatgaattatggtgcccctcccccttcctgccttctttacccccttcttctacctctcctcctctccctccttgtcttcctcttttactccttcctttcctctgcccttcttccttctctctctcatctcctctccccagtcctcccttcctttctctttggaggccaggtctcatatataacccagcgtgtccttgaactctctatgtagccaacaatgccctcgaactctttaacttctcttttgtaatctgcttttaaaaatctctgtacgctattgtctgtatcctttggatactgtcttataattgctaattttcttataacctggacttttattagatgattttatatacactttttaatgctcagatttctgctggttctttgcctacccatttagtcttcattcatatctactatttaaaattatatatacgtatgtatatatacatatccatatatatataagtggtaagatatatatatatatatatatatttatatatatatagtagtaagttctttatctgttgaggactgacaacacactcatttaaatgtcatttaggaatggcttcattgcttggatcttattggcgatgaatatcagccttctgatttttagccccgatgttggctgtctttcctaatattggttttctgagtgttttggaatttaattacgcgggcttacctccgctggaacattatggctttttctctctgtgctcattcgttttctgtctgctggcgtggcctccagctgcctcctctcggccagcccgcagcgaggggtcagtgtggagggtgcgtgagtcgtggttatcgcagctgggacagcagctccatcagtgtctcctgtcccttgtgcaccgcctggctgcagcccgtgcagggacgttggaggctttctgcaagggggaccttctccatcagtgccttctgcaactgcagctgggcccatccttccagcagggctgcatcatccttacgcttggctgagttgggccggccttttatatttccctttaaatacggaatgtatgtcttacctaacttcgctaaacccgacaggaagtctgttgcctggcttttcttaggggcgtgtgaggagatgcacctcagatagggaacctatgtcagaccaaaacgcgtctcacctggagcgctaataacaggaacatgggtgaggggtgacttacaggatcgcggatgactcaagaggcggctgcacccctgacagctgccccagcagggacggtgacgcctggcagcccatgggccccagagcctctctccccagcctcccccacggtctgtcctagaacccggggcagcagtcttagccctgcaggcctcagcctcccaggttttgtttttcttcctcagtctcatgagcctctctcctccctccagagtagcatgtttgaatttggaggaattgctttaaagtaagtcacagagaaaatcaattattagataaaagttagcaagatggcatgtgttacagggtgataaccattaacagagaattgaagtttgagtttagctgacaacagccagcaggtgattttattgttgtttgctttttttttttttcttggcacatgagtaaacaagtaaagaggaagcttggtgtcttgctaccaacctcatcataaccagaggcacctctgtatgtagacagaagtttccgtgctgcctggtcctgcagccagccgttctgtcccaaataaacacaaagaggccaatattaattataaactgtttggcctacttctcaggcttattaccagctagctcttttgtcttaaactcacccataattatttttttttaaagatgacaaatttccaagatgtcagaatattttttttttttagattttatttatttattatgtatacagtgctctgcctacattcacacctgcaggacagaagagggcaccagatctcattatagagggtcacgagctgttacgataaatctttccaccaaaagccgcctgagccccaccgccacttgtgagctttacgccagccgcctgcccgagttagttccaaatgaatacacagaaacttgtattaggttcaaagctgcttggccaatgactaggattcttcatctgttagcttagtcttaactatcataaacctatatattttataagactatcttatcggacgccttttataggcgtccctccttgccggtggatcacatcctgccactggagcaggagcggaggggaaaagagggctcttcctgtttctccttctttaaatatgagtctccttgctatgtcacttcctgcctggatcaccacttctctactacatttcccagaatcctctttgactcctagttccgtctaacttgctgtctcattggccaaacagtattttatttaacaatcaataagataaacatacacagtagtacattccccatcaacgagcccaccatgtgggtgctgggaattgaactcaggacctctggaagagcagccactagctcttaacctctgagccatctctccagccctcacccataattcttatctatgtttagccacatggtgatttggtaccttttctcagtaaggcattctcatcttgttttctctgggtctggctggtgactgtgtctctgcttttcctcttcccagaattctcctagtctggtagcctcacctatacttcctgcctggctacttgccgatcagtgttttattaaatatgagtgacaaatctttactttgtacaagagcattgtcccacatcatctgtatattaggaataatgcatagtgacactccatcaagacttaatattcttgggctggagagatggttcagtggttaaaagcatttgctgttctcccaaaggacagaggttcagttcccagcacccacatggcatctcataaccatttgtaactccagctccagggaatgctccaggggatctgatgccctcttctggcctccttgggctaaacacccattttatatgtttcattttatatgataaaatgaaaagtaagaaaaattaacattctactcgccccatcaacagttaccattttaaagagtaatccagagtcacgacacaactggaccttttgttgtttgtgtctaaacacctaattccagttgtggagtcaacaagagaaaatgtgttgaagctaaatgttctctgagcagccatcagtgagattctgtctcactttagcccgctgacattacctggcgtcagaggtttgctttgacaataatatttgggagacattaaatcacagttgtgccgtcttccgtgcccatttgttcttgagactcataggatttttatttaataaccatttgcaatatttgattagaattggaatcagagtggagggcagggggaactggataggaaatgtcaaaattaagtagcaattacattagatattacattttgttgattatgttttcttaaaagtagtttaactttcttagtgtttcacttctcagacttaatttccgatagttcagaactgtctcatcttttctctgtgataggtttgtgactaagttgttggaagacctcatcttctttgtggctgacgtgactaacaacggacaggatgttctggatgtggtcatcaccaagccaaaccgggaacggcagaaactaatgagggaacaaaacatcctggcacaggtgagttgctttgagaaccaaatttgcctatttttttgttttgagttacagtgtcagttatgccttgctgcataacaaatgacacctagacacttatttcagtttctatgagctttaaatgtaagagcagtgtctgaggggcatcctcagagggactgtcagtgtgttatgtagggctaccgtcctctcaagacagaatgagaggaggtccacttcctagatggcttgtagagttaggtgcaagtctgcctcaggatacagcatttcctctggtgatggttgtgttagctttctgtgacaatggttgtgttagcttcctgtgatgatggctgtgttagcttcctgtgatgatggttgtgttagcttccagtgatggttgtgttagctgaagtttgatggcttgagaatcaccgagagacgggctgctgagcctataaggaattaccctgactatgctagttgactcattaggaagactcattaactgtaggccagcccaccctctgggtggagatcccagacagcagagaatggagaaagatctgagcatgcattgggtgctctctgtgcttggctgtggacagtgacagcagctgctgggagctcctgctttgctttcctctctgtgatgagcttcagcctcacaccaagacatttcccttaaaagcaacggattccagagaagagagagggcacctagacatagccatagtgtaggaaaaaagggccagccaaagacacacactctgagcagagccaaagaaacacactttggtcctgcaaccagagccaaaaaaaaaaaaaaaaaaaaaaaaaaaaaaaaaaaaaaaaatgaccctgaaaccagtgcccaagaaacacactttgtccctggaatcagaaccagtgaaagaaatacaccctggccctaaaattagagccaaaaggctaaaaggaccagtgaaagaaatacactttggccctgaaaccagagccaaatatgaccctgaacccgagcagaaaaccaaccaatccctgagcatgagatctaggcaatttgagctcagggactgaaatctgaccaatcctcaccctgaaagtcttcttcctggaaaactccacccctaagaagccctgtataaatcctgtgcctgttcagcatgtggctgtttgggctgcccgactgtcctcttccactctgacacaggcggccactctcctggattcttccctcccaataaatctcgtgaatgaggtttcggtgagactgtaacactcagttttccttggctccagagtgccagaatacctttccatcagagccgtaatgcttatacatagtctttaaaacatcaccatagatcccatatccatcagttctgtgtgactggttagaagcagagagagaatcccacagggacatggtcggcagaagttagggaccatttgaggctagcttagaggtacccaccacacatctccaaaataccggtgtggtcagagcatcttaagaaacaaattcccaggtgactttggaactgttctacctgcttccatctgctctaggaagacagcagtccagtccagatctctgaagtgcatgacacactagtaaattaacctgctttccagtgacctgcatggacatccctgtagtcacatctttttattgttttatttgctacttaaaacaattagcttctgtatcaaccacatatggataattgaaaacacaaaaatgacattagtttataattaacattaactgctgggtgatggtggcgcacgcctttaatcccagcacttgggaggcagagtcaggtggatctttgtgagttggaggccagcctggtctccagagcgagtgccagtacaggctccaaagctacacagagaaaccctgtctcaaaaaaccaaaaaannnnnnnnnnnnnnnnnnnnnnnnnnnnnnnnnnaaaaaaaaaaaaaccaacaacaaaaaaaaaactaacatactgtgctgagctggggaaggaaaaactgaagacccgttgtcagctagtatctatagactgtctgaagacagtgcttttcagaaataaagtctcaggtcttgttagactcccggaaaactcaagtatccagggtcccaggccacgtcttccgtcaccccaatcaccaggcggattcgagagcttgctgcaaactgcatgaggctttattgtaatttaacgagctacccccatgttagcccaggccttccatccccccgccatggcggatggctagcaaagacagtttgaagccgctgcgcacagatcttatagggcagggtggggggcatgtctaggggtacgcacaggctcaggattggtgtgcctccaggcttggagggtttgccctgtgttgattggtcaactggttgttatggctcttaggccctcccagggtggttgctatgctctctgcgtcattgctgtgtgcttgtccgtaaagctcacccagggtcgtaaagcacagcaccaccagctaacttctgattgtttccttgtcacgaggcaggcatctgactttctagtgtctaggacaaggtcatagaagcacgtgttcggctgttatggctgccaaaagggaagctggtcccttcagtctcagggacaaagtctttctgccatctataacgatatatctttccaccagctgcctgggttctgccaccgccttagagcccctgaataacacacagagtcttatatcagttacgttgctgctggacaatgactaggatttatttgttagctcagtcttaattaccaaccataactaccaatctatatgtttttataaggacttatcttacccagaactccagccttatgtgtcctctcttcctgggatcacatggagactctctccctttcctacatttcccagaatcctcctcctctcctagtcctgcctaacttgcttccctattggccaacagtgctttatttatcaaccaatagggcaaacacgtacacaggacaccctcattagtcatcagtgaattatttttagaaagcatttgatttcagggacttttaggactttgagtgaattatgagatattaactgatgtctccaacctttttatctcatgatacaaatataaaattcaaggttcagggaacatcaaattcttcttttcaaaaataatttttatttttaagaacttcacacataaacaccaactgcatttatcacatctgcaccaccctccccccctaacttctctgtcctccaaattcatgatgtccccttattgtaattattattatatgtacacgcacacacatgcatgtgtacatacaagggactgagtccgtttagccttctcatttgtgcccagtactggctgtgggaggcacaccgaggacactctcctaggacactgtcctctgcttctggcgcctacagtcttcccatctcttactcctccacgactttcaagacttagaggttggagacctgtgcagatggattgatagacttgggcccccagggctttagtctctgaattttgaccagttgtagatctctgtggcagtctccacctgttgcaaaaaagactctttgagaacaccaaaggctcaaagaaaaccacagtgtcttagttcatgaactccacgggacagttcctttccattttgaattcttatttcgaggctcattgtcttgatctcatgttcctcacagagaactaagcctgctggctcctcaccagaaggcaagaatttggctccctgggaatgggggaggggctgagggagtggggatgcaggggtggttccttgttaagacttcagtgtggatgcattcattcccatggccacttatctgcgttctgtgaacagtggacaaaccctctgagaaagttttgtgtatttaggatctctgttattgggggcatatgtatttggaattatttccttttgcctaaaaggaggtaagagtgacatttggaagtcattacctgttgtaagtttcaggtaaaaagttaacattttttaatattattttgattttggaaagttatagaaaaataacagaataataaaagcatatagaaaatatattttaattcgtgtgaatatatccatgtagcttgatacaaacaccttcatatttcctatcttaataaaatacggtttctaaataaaattaatcatgccattgatatagtggacttgttgactgggtgctctcgtgagcagagagtttttggttcgacagtgttttatttattattcaggactaacagccagttaagtaccttctgcctttgcactaatttcacttacacatttctacagtgcttttaagtccgtgttatttgttaaaaatgcgaaaaggttgcagagtgcacacgcgtgtccataaaacagaaggatcttcttcttctaggtgtttgggatccttaaagcgcctttcaaggagaaggcgggagagggctcgatgctgaggctggaggacctgggcgaccagcgctatgccccctacaagtacgtgctgcgcctctgctaccgcgtcctgcggcattcccagcaggactaccgcaagaaccaggtgggtagggagcccgcgccctggtgttggtggctgttaaagtatagaccgaggagtcagaactcgaactttgcaaagaagggctttatgtgggcggctcagagaaccgtccgtgagggctgttgagccggacaggagtttgacttgcaggcggggatgctgcgcttctgggcatggtcccggagggctcctgctgagcagggtaccctggcctgtgcctgggaggtgcagccttgctgtgtgcctgcatacctactaagataccatctgtggccaagattcaacctgcacctgaaacaggaggagggactgaggggaggagggatgggatgggggcagaggaatgcgatgctcgacgctcaggctggcgagcttgagtggtgggggctgggagccgtcttcatgaccgtatggaacatgcattttagggagacaggataatcggtttggttacttttcttccctgtgaccataaattatcgacaagaagaaactcaagggagcgagggcttatttggacccacatttgaaggtgtccagactgtcatggaggggaaggcacagggcgacccctcgcctcttggaagacaggaagcgagagcaaacaggaagttgggttataaaacccgcaaggcctatccccagtgacccacttcctcccggaggctctaccgggaggctcagacttccacaactcctacccctgctggggaccacgtgttctgatgcatctgcgcatgcaacagggttaggacatcaacaaggtcgccgtggtcatagggcagcctgaactgtggaggagagtgggcggcttgtgtgggtccagggatggagccaaaagctgtaatctgctagtgaaagttatttcgagtctcactttgtcttacaaatatgtagagagtctagagagatgtttcggtggttaagagcactggcttctcttctacaggacctggggtcaattatcagcacctacaaggcagctcgtgtccaatgtcccttccttctggcctctgttggcacttcaattatcagtgcttacaaggcagctcgtgtccaatgtcccttccttctggcctctgttggcactacaggcacatgggtgtacatacatacatacatacatacatatatgcaaagtgcataacacaacatacaggtcatctttaaaaaatctgtaatatttgcattgggttcaataatgcaaatgttgacataaagatatttatattattgatgacctggcattgtgttctccgtgtgcttcttatccagtagaaggatctgtatcactggtgtctaacattttttttttttttttttttccgagacaagagtttctctgtgtaatcctggctgtcctggaacttgctctgtagatcaggctggcctcgatctcagagctctgcctgcttctgcctcctgagtgctgggattaaaggcacgagctatcagttgctgagtttagttcatgagggagtatggcctgagagaaggctgggaggcagggcctgaggcacagagctcaaggccactgatgaggaggttcaaggcaagtgggcaacactcaactttcactcactttgtttcaagcctaacagttttcacaaatccactgagaccaagaagccaagcaggatgctcagacttacagtgtttttgttttctttctttttttttttttttggcattgggaaacaaacttgtcaccaggtgggcactatgacttagctgcaccctcagctgccaggctatggttttaagaatggatccagtgtgtaaacccaggttctgagtcatcgttgagagtttggaagtattttggcaagaaaacaaatttttgttttttccttcaggaagaatgtgttaaaatatgttggctttggaattcagctttcgagatttgaaaagaatatgtaaagcagattagttagacaataagtaaatctgttaggtaacaggaacaaactgacagtttaagcaggcccttacacataccatgtatttagatccatgtcatacaatatataatacaatgagcatctctcataccctccgggtgaggaacctagttctttgtggttgaaatgtggcttcgggggtcacactaatagtttcactacattccagtgggatgacagtgtagagagtaatgttcctgtctccccgggaaagggcatagatccagaatgctgaaacagacattaggcattggggttgtggcactggagacagtcctgtgcagcacccgactgtctgagcacagggtcggttggagaggcagctcagcgggtttcatgcctccccacttctcttcctgggtcccctgaatgagttacttttcttgtagctgtgatcaaagcctgtcaaggagccacgggaaggagaagttgtttatctgggctcagtttaagggcatcatgacaaggatggccgggtggcagcagcataagacagtggtttgctcacatctggcacctggtgttcagagtacagggtggggtcaccctgaaaacacccatcttcctgtcaagcagacacatttgaacatgtgcatatatgcgtgcgcgtgttgcacacacacacacacacacacacacacacacacacacacacacatgcctgggttgatatttacgcactctctagattccttgcagtgtgtcactgtgggtcatctatacctccccttccctccccagagctaagtcactgatctgaccaaagagcaaggtctccttggtgctcactgttcctgcagaatctcattgactctaagctatgtctggacccccttttttctgttctgttgaattaagtgtgtttgcattttctcagacccaaatgggggtacccctatcatccccaaagaccaagggaccatttcagaagagatgatgggaggattgtaacagttggaggccagggtaggagccctgtgaaatgctgtcttctggatatggcatgacgtgacacgatgtggtgttcacctgcacacagtagctgtgttatctgcatacggcctgcacacacaacaagacggggctaatcgggaggaagaagaggggtctgcaggggcgagcagcaaattagggaggccgatgaagcacagacatggtcacaatatccttcatacgtgtgtgaaactctcaaaagagctgaggatgcttggcattgagccagaagcagtgtaagatggtcttctctcaagagtgacccgtgtgaggtcactgaggagagttacctcaggcgtgtctgggagggtgtgtccaggtcttcaattgaagatgcaggatcttgccagtgggcggcaccacctgtctcatgggctggtaataaaaagagaaagtgagccgagccccgccccccccaactgagtgcaatgaggccaccttccctcccttgccctggcttccctccctcagtgaactgtatcccttgagctgtgagccacagtaagctttccccctaactgctgtaagtagcttgtgggaaaatattttaaaatgtagataaccaaagcaaattttagaattcctattgtccccacctgcatttcagacaccagtaaagagctcatgtgtgatttagtgctggcccaggtatttaacgttgtgtttgggtttactattatttagagaacccaatatcacctctaatttcatgtaattattcatcagcatcttggaagcttgcctcacactacagtacgaccccgatggccataaacgcgtgtaaatcaatatatagctctaaagtgacacactgcagaggacttttactttagttaattgactacccaatagcaaggcatcattccgaaagaccacaaaaaaatgatgctggcgttataattagatttgtgtaaccaatatcattttcaaggactaggtatgttccggtaaattttgctcaaggcaaaagccactttctaatcgatggattttctcatctgagaaacagaggtgcattcccaaggagaaaccccgagaaatagaaaacctttggtcattgaaatagaaaaccttagtgctaagggtctatctatacacagaatgagaaaaccagtgattgtggtttgggatataggagtgagaatgaagggtgagggaacaggctggagagacgacggctcagccagtcagagcactgactgctcttctacagggcctgggttcagttcccagcacccacacaggggctcacaactgcctgtaactccagttccaggatatctgacgccctcttctggcttctttgggcattgcatgcatgtggtgcacagactcacacgtatgcacacaaataataaatattaaaaaaaagaacagggagaagactaaatagtgcataactgaaactccccatagtgttctgtctctcacggttacaataacattttgcccggcgttggtggtgcatgcctttaatcccagcactcgggaggcagaggcaggaggatctctgtgagttcgaggccagcctggtttacagagcgagtgccaggatagcctccaaagccacagagaaaccctgtctcaaaaaactaaaaaaaattatatatatatatgtccacagttttctctaccacagggcctttgtgggtgccactccgttgcttggcaagcctctcctggcgctcccaaggttgctgtccttacctccttttcatccttgctcacacattgcttttttttctgcctccctcgtctccatccttggtttcatgtcgctcatccacgtgtgaaagcatgtctgtcttctcatttgctctcttttatctcatagcgtgatccccagagcttttgacgccatcatgaaacagttattgcatggctgaatctaattaataattcgagttaccatgtgatcctatttgattgctccttactgataagtatgtcaagtttttgctgtcacttatcagagaagatcttgttggtcattctagtgtcaatctgaggaaaacaaacaaacaagacaactggagcccatgtagggcattcaaacaatggctgcaccgatctcaagtcccaggagtacggcagtcacatacattttaaaaattattattattgtttattatttatagttataacttctggtgagagtcagagaggctccttgcaggctggtgaaattctaagttaccatgacgttaaaaactatagttagatttccttttctcacttacaagggtgtcagtacccatttagaaaatagtgattagtgacatgacttttaattaattaattagttagttatttgaagtattgaggatggaaccttgacccttgcacatgccaggtgagtgacctctcccaaagctctgccccagccctcggtcacagtttgagttacctgactgtggatacctttacttccctccaggaattctctttactgaggcgttatttacttgtttttcttctgacaagcttcggctgggttgtccggtggctcaggtgatcctggctgctgccccccagggagctgcgcttgcaggcagtgtgctccacaggttctgatgcctcctcctccctacaggaatacatcgctaagaacttctgcgttatgcagtcccagattggctatgatattctggccgaagatacgatcacagccttgttacacaacaaccgaaaactactggagaagcacattactgcaaaagaaattgagaccttcgtcaacctgctcaggaggaaccgggagcccaggtctgtgctctgggggatggaagaatggggtttttgttttgtttctttaagataaaaaaggtgagcatctattgtagcactgactcttggtgggcagacgaagcgtttatttccatgataacggtgtgtgtaaagcagttctgcttctcaggtgatcagcatcctttagagacactgttgatgtgtctccttggtgctggggagccaacctaaggctcacactggctagaaaagtgattggctgctgtacagcaccccagccctagactggcatttaaatgtactcatttacttctattcggttttccaaaatacattcatgtattttcacacctgtaatcccagcttctcaggaggctgagacaggaggattacaaggctagaaatggggttatgacagtgagtttaagaacagctagtagggccctgtcacagttgaggagttagcccagtgggagaatgtggggctcaaggactaatccccagtaatgcaagaagaagccagaagcccaaaatgtgttcacatagactcactcaggtgcccagattgcagatgtgggccacatgtgtcctaggagagatgaatgatgactgacacatttatgggccatggcaccgtgttgtggtgtctaaaggttgggcactcctgatggggcacttcatttaataatatacagtgcattctgactgctacctagattttaataaaatcaagcaaatgacttattatctatttcttttttggtgctgggaactgaacctaggggtgttcagttttattttcctttatttttcctctcacaattgtaggcctagctagcctagaactcactgtatagccggggttgactttccctctaaggcaatcctcctgcttcagcctcccgagtgttgggatgataaaagtgaccacacatttggggttacccagcttctaccttcacttagaaggagaaatgaaagacaagcaattagaaagggggtgccgggtcataggggctacacattctctttcactccatgctgccttagatggcaacagtgaacacagaagccaagaacacccactgtgctttctctgtctagtcctctaacagtaaaatactaggtggacagcggcctcccctttgaccaaccatcctctcttgaagggtgctccctaaccctgtatatattctgaagtgtgctccccaaccctgtcagttgctacttggttttggagacactcagggaggatgagtcattgtgctgatggatgtgcatcacctaaaacacagaagcaaacgtaacccattctgaacaaggcttatacgtaacagaaagaattgtctattctgcttttaatggtgcaggagacgaacagcacacaggaaaacacggcactgaaacaatgttaaatttagcttcttttattcaattccaaattacatttttgttgcgacgattctatgaggatgctttgtcgtgctggcgagatgctgttgttagtgtgtggaagcctttgccagggaagcctgagggcccacgttctgtccccagatgtctggtagaagaggacagggacacttggcacactctgtgatagcagctgtcacactagcagctgtcacacagcaagatgggaggaggaggcaggacagtcagcgggaaatctgggccaggtcaacacagtccagcagaagcaggagaccttgcctcaagacggaaggacagaactgacccctgaaagttgacctctcacctccacgaataccatggcttgccagaacccatgtcctgacatgggcgctctttaaaaattaaaaaaacaaacaaacaaacttaaattgatgagtggaggcactcaagatgctctgcttgcaaacatgaaattgttggagagtcactaaaagacaatctgttgaaacataaaaatgaaatgctcttttttttttcacgtccactttcctcctcctaggtttctggactatctgtctgacctctgtgtgtccaacagcaccgccatccctgtcactcaggaactcatctgcaagttcatgctgagccccggcaatgcagacatcctcatccagacaaagtaagctgcccacggaggtgtctgttggacatccctcaccacacgtgtgtgctgcctcatagactttgtgtgtctttgtcttccaggctagtgtccatgcaagtggaaaaccccatggagagctccatccttcccgacgacattgaggacgaggaggtgtggctctactggattgacagcaacaaggagcctcatggcaaggccatcaggcacctcgcccaggaagccaaggaaggcaccaaagctgacctagaagttctgacctattacaggtactggggacacgcgcactctccatcaaatatctgaagggagctggcgtagtttgtcgtgcctgggaatcaagattcgctagacccagtacaggttaaaaaaggcttattcagagagagaacacaacactggaggcaggcggctgccgcaggttctggctccaagcatcctcccaggctctattctgtccccaggtcagcagccagagaggaaaaccaacctaaaacctcccctcctgtacatacctgtgaccactcccaaatgggtgtggtcagcgacacaggtgcatagttaggtctttcatcacaaggttctctcaaacctctaggaattagagacgaagaagagggcacttgaaaactcagaaagagaggaatggagacggtcagggccacctagagatctcagaatgaaagctaacacatgtttcctgcttgcactctctgatgagttggggacttgtcagtaaggcgtttcttcctgttacctatgggaagtcggggctggtgagaagcaataggaccttgactgtggactgagggggaggaggcactgggatgagacagacgtggccacaggggtggccctcacagacatggcaagatgggatcttgtgagcgtgtgctccttggcacttgacaggtgcaggtgcctgtagttctggaaggagacccgtgttgattagcaaaagcaggagaggtggttcccaggggtcagtgtgttgggatcaataactgagccagagggctggcaagaggtctcagccagtggaaatgcttgtcacataagtctgacgattctggaggcaccacacccccacttcaacagaggcaggggagggtggagagaggtggcttcatgtgacttactgtccattccaggcctggtgcactgggtgttagggctgaaatcctagccatgagaggggttgtagtaacagggacagtgttagacccgtgctgtcatctgctcatggccaaaagagtttggctcagtgtcgtaaggacttacaaacacatctgcacacccagcagctggctgtgttgtgctttgttgtggaggggccttaacggaggcaagagggataacgtaacatgtctcatcctttaggtaccagctaaacctcttcgcaaggatgtgcttggaccgccagtatctggccatcaaccagatttcaacacagctttccgtagacctgatccttcgctgtgtgtctgatgagagcctgccctttgacctccgagcctctttctgtcgactcatgctccacatgcacgttgaccgggatccccaggagtctgtggtgcctgtccgctacgcccggctctggaccgaaatccccacaaagatcacgattcatgagtatgtttggaaactattttttaaaaattatttgttttatgtgcattggtgttttgactgcatacatgtctgtgagggtgttgggtcccttggaactggaggtagagacggttgtgagccaccatgtgggtgctgggaattgaacccaggtcctctggaagagtagtcagtgctcttaaccactgagccatctctccagccccagttagttgtgatgaaacaccatgaccaaagtaacccggggaggaaagggtttatttgccttttgcttcccgtcatcttcaccgttgaaggaagtcaggataggaactcaagcagagtaggaacctggaggcaggagctgataaagaggccatggagggtgctgcttactggcttgctccccatggcttgttcagcctgattttttaaagaacccaggacccgggctcacagggatggctccacccacaggggcctgcccctcccccatctgtcactaattaagaaaatgccctacagtcttgcctatagatggatcttagggagacagttcctcagtcgaggctccctcctctccagtggctctagctggtgtcaagtttacataaaactgtccagtacattgtatttattacttttctcatagctgacaagaaacagctttattgtggtgcacagtttgagggaccagtcgtcatggcggggcctcgaggcagcgtcaccttgaatcttttctcaggggcagaaagatctcacttctgattttttcctctctatctagtaatggtttcaatcccagggaacggtgctctccacactcaaagtgggccttccctcttcagttaattggttctggaaatatcctcacagatgtgcccagaggtgtgttttctagaagattctagatcctgccaagttgacagtgaggatgagtgttccaaagtcagcagatgaaagccaagtcaaagtgactttaactttgaaaagaaaaacacaggaagggatttgcccatttctgttcacagtgttcacctgggaagggtcagtaagatgccctgtcttgagggcaaaatgatagctcctcagcaggaaacgtgttcccggaggctagtaaacaaaagtcctaacactcacagctgagtgtgtgacacctggcagactccaccgcacttgttccatctcagttggcagtggcccctgccacagacaggatgtgtaccccaagaagttgactgatgtgtccaaggcagagcactgtgggagtatgaatagataacatccccactgtgggtaaggcaaagcactctgggtgtcagaataggtaacatctctactgtgtgcaagggaaagcattctgggagtcagaatagataaaagccccactgtgtgcaaggcagtgcaccctgggagtcagatagataacacgcacacttctcattgtttctcatcagcttaactcactcttgtgtcatctgcccaggtatgactctaccacagactcctccagaaatgacatgaagaggaaatttgccctcacaatggaatttgttgaagaatatttgaaagaagttgtaaatcagccatttccttttggagacaaagagaaaaataaactgacatttgaggtatttaaaaattttaaatattttctttgtgcctggtgcccacaggtcagaaggggacatcaaatcccatggaaccagatgatggagagccatgtgggtgctgagaaccaaacccaggtcctctggaggagcagccagtgctctcagacactgagccgtctcccagccccacttgaggtgttttaaagaaatagtcactcctggcatgattgtgtgttcttgtcagaaatgagatgcattgaacaccatagattttccttccctctgatatttagggtatctaggccgttgaattgttaggttcaggcagatacaaatctgtctgatgatgacaaaaatatagatttggcatctatattaacttacttttgaaactatatatgatgtgtagaaatgcagttcatatgttaattagaccacaatcaagtgatgtgacactctttgaatcataagagaaaagcttcaagtcacataacgagtccctgtcccctgtacaaatttgaaaaaaaccccaccttttcttagtgagttaggtgacatatgtactcagtgactagtaatgccttgccccagttatactaatggacaatagaattacaaataaaagctcattttattttaattcttgtatgccttgataattaaaatgttctatctcaattatcaatttattatagctttccttgttttatttttctttcatatatgtaaattttgttgtacttggtaaacagtgacagttttagatactttgtatttagatgtccttcccccatcttcacgggaatgatgagttagcctcattgacatgaattgaaatttgaagacaatgtaatagcaaaaccagagagagaacactgtcacaccatacctggtgtgttagctgtccactgtcatgagagatctcacccccagtgtggcagcccaaagtaaacttcagttctgcgagtcacaagcctgggtatggtatggcggtgtctgttcagtcactactggaaatgcttgccatttctgcctcgctcaggtggatgctggtggctctgcttctgtgctggcttgtccacacacctcagctgtttgccacatggcttttctgtgggctgagtgttccatgagtgtacctggcttcccacagagtgagagcaagaaaaacgagagaaggagagagtgagagagtaaggaggggagagagtgagagggaagtagagagggggagagggagaggaagagagaaagggaagggaggggaaatagagagagtgagaaagggagagagaatacttaaatgcagtgtctaaccttggctaaccttgatatggcgcagcatttctgctgaggcacacgccaatctgacacatcgtgggaggacagctgacattggagccgtgtcttggaggctgcatctcacttaattatttctctagtaccaaggaggccacaggccaggataggggacataaaactctgggccaatttatggctcacatttattaaagtaatttaaccactgattaagtggtatcttcctgacttacattaattaagtagtagatattgtaacataaactccttaaatcacattaaggcctcttatgaatagaccctagatttggatcagtcaaaatctgaacagcagcctttacaggggttttaaatcctaggtattaaagaattagggacttagaaacaccagaaccactttagatgtaaaaattgcaagtgtttattccattttccaatgctgttctgtcctctgctcttcctgtgaaggtggtccacctggctcggaatctgatatactttggattctacagcttcagtgagctgctgcggctgacaaggaccctgctggccatcctagacatcgtccagacccccatgtcatcgtattttgaacgattaagcaaatttcaagatggaagtaagaacttttgagaaatgtgataatgtttttgttattaattaggggtgagataaaaaagcaaacatagagaagcaatccacacaggcactggctcttgatgggttacatgataacagggtgggcattcaagcagtttcctttaataatactggtgtgtgtgtgtgtgtgtgtgtgtgtgtgtgtgtaggtctgaagcggacttcagtcagtgtccattttgactgctgtctactttattaattgaggcaacatttcctgataaactcagagtgcactcatcccggctactctaggtattgccctagggagccccttgactctgcttccaggagtgctggggctgcacagctactgtgcctgcttggctttgccatgggttctggggatctgaaccatcagacttttggtagtgtccatataataaccatacattttttggaatggtgattacattcagatggaaagttgtttctaggagttataagggagtgtgtatgctggacataaccctgtgaggatgtcagaggaggaggcttgggcagatgagcagatgttcagtactgaactgagacctcaggtcagcacgagttgtctcacacggagataagagggtcagatatgtctttgtggcagtcattcattagcttctggcttcattgtggaagaaggtgtgagacaccggggaagctgggataccctgcccaggagtcatgttgagtgacacagtgctgaagctgtcggctgggggaagggcctctgcacggagcacagtaatggccacagtagtacccaggacataatggaaaaggaaaaccagatttccaagttcaggcataaagagggactgtctgtctgatcagtaatttcaaatgagggttttacagaaaagctgaaggaatgaattgctgttaccccaatctcagtctctttaacatagcacacgcacacgctcgcacgtgctcacacacacacacagagacacacagacacacagacacacacacagagacacacagacacagacacagacacacagacacacacacactgacacacacagacacacagacacacagacacacacacacacacacacacacacacacacacaaaacatttaagtccttcaccttcagggcagcttgagtccctagtccagcaaagacttagttactgcagcagaaacagtgatggtctgaacagttattctgagagctccaactactaggatctctagggaaaattttgtgtagcttttacatggacacatgtctctttactctgggagcaggcactgatgacagagcaaagggataatcctattcaaatctagctcagtgaccagtgagttactgtgttactaacaggagtatgtgtgactcaaaaacttacccagcatgggcagctcaggcaagctcacccctggagctcccttacaacttcctggcagccaggcagaatggagccatctcccccacccagcaattgcttattgcatctataacctcagtgagggggtttatggattatgtaaagtttcagaaacttcctgagtcttgtgtgtttcatttacttcctttgtcctatgagttttcctcctctctctgggagggagtgtctcaatttgggggaagcatgcacacactgtgactgtcctcataggctcaggtgtttgaacactggcttcacagttgttgtgtcactgaagaagaatcttgttggaggaagcaggttactaggagagagcactgacgtttatggccaggctccacttcctgtctgtggagacgtgagaagttggtgcatcacgtttctacctccatgacttctccaccatgacaggctgtgcctcttcaaactgtgagccaggaaaaatccttccttccttaaagaaataaaagggggttgtgtgataatcaccccagaaagtcgaaataccgagagagtcacatagatgagaacacatagagaggaagggacctaaaagttccgggtggaggcttgggagcttctagaacgagtaagtctggaagtggggagaaaggggacagacccttgagttttgtgtgcagagagaacaaggactacgtgagtctgagcagcgtcacgtggagagagagagagagaggggggggggagcatgtctgtgccccctccagagccacttaagagaagtgtgctgagcgagctaagcttccacttccaggccccagagcaggtgagcatgcccaagacccttgacgcttaagccagacaaaatcccagcatgcagagggaaggtgggcacaaagtttcactccgagctgagaagccatcgatcactgacagctgctgggagagggacaatcatgtttctttgagggtgtggtccttgctaagttattcatgctctggtggatgttcccatacccaagtctacgggagaggtacaaattgtacttaatgagttaggaaaaattaaaggacatgaagttgtgtgtgtgtgtgtgtgtgtgtgtgtgtgtgtgtggcagatcctggaggaatttgtgggagagagaagaatatgatcaaaaaacactgtacaaaattctcaaagaactaaaaaaaaacaaataaacaaaacccccaacaacaacaataacaacaacaaaacaacaaccaagccagtaaagaaaaagaattctcttagagactgggagctggccacagtgccctgtctcttactgtaaagggggcattcggatcctcacactcatccatctaacacagcttattggctgggctgtcagtcagggaaagaaatactgttttcaagcaagggcattggctcttggccctttgcctagcatcataccgtcattcgctgtctgtgatttaaaagcgctgacggtggaactgatcgtttggattgaagaattgtttcaggaggcactttttttttctttgtcacacatagaagtgacaaaaaacagaagaacttaatggccaacacatgggacgtctggggaattatttgcaagtggcacatttattaaattatacaattgttttctttttatagcaaaggaagtacaatccaaagattttgttgttttccttttcatgcatgcatagtgtatgcatatggtgtgtgtttgcatgtgtgcgtgtttgtgtatgtggtgtgtgtgcatacatgtgagtgcacacgtgtgtgcatacgtatgtgagcacatgtgtgtgttcgtacatgtgtgcgcacacatgtgcacacatctgggggtgtgcagcatgtggcggcccaaggttgacgctggggaccaccctccattactcttctatcacactccttgaggcaggtatctcagtcaaacccagagctaatcagtacggatacggatgttctcactagctagcttctctgtggttctctctgccctctgaggtggaattatacctgacttgtaagtatttgatcccagatcctcatagttctgcagaaagcactttaaccattgagctttctttccagtcccagacttgactttctcctgatgctaatgataaaggctgctccacaactgtgggtctcactgcacccacccttccctcccctcattctcctcctcctcctctttaaaaaaatcatattcacgcatacatgtgctgcgattaggtcaaccccaccctcgttccattccagccaactccttacctatctccccagtttatctctcctaacattacgtgtttcctctcttattttgtttgatctttgatgttatttttaattaaacatttaaaattactttgcttcactctcccctttccttcttccagtccttcccccacacctctactctcctcctcaaattgatggctccttttattattgttgttatatacatgcacaaatgcatgcatttgcaaatacaacctgcccagtctatttagactgtcctgggtatatacgatttcagggctgaccacttggttgttggataaccaattagaggcttcattcccaagagaagctaagttatgcctccctcagtggtcactagttgcctgtggttctttgtttaggagctggaccctgtgtgatttccttctgtgttagcatgtttattgatgttttcattgtttaggtcttgtttaggaagccatattgttgacgtatcatgggtgtagcttccttgtcgtttctacacaatttcacagtagacttcctggtcctctggcccttaaaatcttcctgctcccctcttccaagattcttcctaagcctttagggcaggagttgtgtggcagatatacccactgggaatggcaccccacaatcagttgacctttgcaatttgaccgtttgtgtttttctgtgatagtatctgcttgctgcgaagagaggtttctttgatgtggggtgagacctacacttatgtgtgggtataaagagttagaaatcatgctggtctagtcaaatggcggtggtaggttctcctctgagatgcatgatatcactagacctgggtagtgggctctgtttctggtagatgggcatgatttcactcccatcgagcagtccaattagacagctgttggttaactccaagataaggataccattattgcatctttagagattgtcttacttttctgttgtcatgagataacatcatgaccaccacaacttataaaaaggaagtatttaatttggggtttacagttccagagggttagaatacatgactgtcatgcccagggagcatgcaattgggccggcaggcgggcgtgggcctagagcagtacctgagagctcagagcttatgtctgatccacaaatactaggcagagggagctaacagggaggttgcagtcttttgaaaagtcaaagcctacgcccagtaacacacctcctccaacaaggccacacctcctaatccttccccaaacagtttcgctaactggggaccaagcattcagatacatgaacctgcggggccatttttatccagaccaccacaggggtattttgccttgctggtcactgttatgatttacaggtgtcacaactgagtaggaatattgattgctttgctcttttaacagtttgtacagcaccttctagttctatgaaagctaggctctaggaggcctttgtattagatacagcctgaatcttccaaatcctgtgtccaaagtgtgtggtgtcttcagcaatagagacctaggatcttcaacctaggatctgtgcaccacctgctgaggaacccgttctctacttttctcaagtttcccaaggaagtcagtacagggcagtttgcatctacaaagaatttttgctttaacttgaggtgattttattgtatcaaaagtttaaaacaaacaaggcattgttctgtttccagtggttgtctgtcttgtctcaggaacagtgttgtttctgaaccacagtgttttaatgttttggaactggtgctcctccccttcttacagtccctttaactctggtactctgctatcaatcaaaggcatcctcttaaatttcactttctgccctttctgtagctcttgccatttctagagaatgatgacgcagctgcttacagctgtgcccaaatgccatcatctcatgagttttacctcttgctgtttctgaaatattactacacagtctcctgccatctccagtgagctgcatctatacctcagataatgcagtcatgcatagcatgctgtgttcggcaaatatatatgtgatcacatgtaagactgtgcatgctgtttagccgcaggtatacatcaggctgtatcctgtaggtttgtgccggtaccctctgtgatggttgtcccacagcacagttgctaaggatcatgctgtcatcgataagccttgctgccctttcctgtcttgctcaccactagaacaaacatatgtgacatgccttttgtgagaagtgtgaatcagacagacaaaactttttagagaccctaacttacaaatacatgtctttatttgttaattaaaaaaatttctaatgactctttggtcttgaagattcaggtttattaagcaaagagaacaatagtgaaatgaaaagctatgagaattggttctgtttctgattttaaagctgacctgtatcaggtctagtgtactaacatatacttatttgttttatacaaatatttatttagaacagttcacttgactatacataaattgtatgctgtccctaaatatacatacatttgcatattaaaatagcattccaaatatgatttgtgaaaattattaaatgagaaggtaacttagtaaagtctttgtcatggaagcatgaagatcagaatccccagaatccatgtgtaaaggtcaggtcagacatagcaatgtgtagtgttatcccagctctgaggaagctgaggtagctgagtctctggggctcactagccatctaacccagcctaattggtgaaactccaggtcagtgagaaaccctgtctcaaaccaactaaccagccagctaaccaagtaaccagccagtcaaccaaataaccaggcaaccaactaaacaaccaaccagccaattaactaaccagtcagctaaccaaccaaccaaccaaccaaccaaccaaatagctaaccaatcaaccagctaaacaaccaagcaactaaccaaacaaccaaccaaacaattaatcaaccaaccaatcaaccaaccaactaaccaaccaaccaactaaccagctaaccagccaaccaaccaactaaccaactaactagccaaccaaccaaacaaccaccaacaaaaagctggatagtacctgagaatgacacttgaggttgacctctggtttctataagtacacaaatatgtacagacttgcacacatatgtgcacctgaatggacagacacactttcacacacactggcacccatgcacacacactcacccacacgcttacacacatgtatgtgaatgcacaggcacatacaggcacccatgtgcacaccacacacacacaatgcacacacacacacacacacacacacacacacacacacacacacacacacagctttatgagctttctagacatacagagaatggaaaacaacatgataaacaaatagctcaaaacaccacctggtattttgtctgtctcaaaccaactaaccagccagctaaccaagtaaccagccagtcaacaatgctgctatgaacattgttgaacacatgtccttatttatgaacatgcattgtgtgggtatatgccgaagagaggaattgctgggtcttgtggtagactgattcccatttgtctgagcaactgccatactgatttccaaattggtcttacaacttttcactcccaccagcaatggaggaatgttcctttttcttcacatcgtcatgattctatttggccacttacacgacatgcttttggtcctttttgctgtaccattttaacagtctatttagatggccactgtcagtacttttaggaggactgacggggaggtgtacacaaagttcacaaaacgagacaaagctactctttatagctccctcaggcggggtttgctcataatcacggtgcagaaatttttaatatttttcagtcattttgagtcaatagatttttggaagatttactcatggttcatctatgtttctgtgagatgtgtcagaagcaaacaacaccacatgcagatttgagcccccggcccctcagctaagttggccagttcacagtggtgaagcatttcctcagctttgctgggaggagtttacttctgtctctgaagctgtgaggagaactggatgcctctggagctgttggagcgacaggagtgggtctaagcagcgctacacacacacacacacacacacacacacacacacacacacactcatacacacacacacactcatacacacacacacactcatacacacacacacactcatacacacacacacactcatacacacacacacactcatacacacacacacactcatacacacacacacactcatacacaccatacacacacaccatacacacacacacacacacacacacacacacacacacacacacacgattccatgtatatatgaaatacatgtctcctcacacctgaaaagtcaaacaaggaaaaaaaaggtaccttatgtgcgcatgaatgacacgagagtgctcaggacggttgctttggtattggagtgggggactttggtgggggattgactctagagggcgtgagggagcactctgggtggtgggaatgtccccgtctggacttcatgtggtgtactcctgcctgcacttttgtgagaaccctgcatacctcccatctgatgctcccaatcacagagcagaattgactccatgtgtggctcatctggccggctgggaagaattaaggatcagttttgcagattaaaatcctgagttttgcaataatactgaaatgtcagtgtttgacagtgatgagacggagcttggccacgtgcggtgcaaaatccttttaggtctccagtgtaggggatgggaagtaatttcctcccaagtcgtctgtgatatccagaggcgatgggtggtgacatcctcatttcctccctgtgactgtgtagcaatcactctgacacaagcaagcagggggcggggaggggcagggatggggtggggggtacggttatttcatctcatacttccaggtcacagtagttactaagggaagtgggggcagaaccatggaggagactgctttcgggcatgctgggatagttttcttatatagcccaggcccactgccctaggaatggtgtcactcacagtgggctggaccctcccacatccatcaacggtagagataaatgccacaggccattgtgaccagggcaactcctctttcaattgagactccctctttggtgactctagataacaggcagagaggacttaaaacaagacacaaattagctgtgggtaaatttcagttctgctaagtctcgagcttcctctaaatccacctgtgaataattgtcagacccaattgtgatttgtaactctgtccccgtggagtgatttatgagacagaaaacttaaatttagtttgtgcggcttcagtgttacacaaatgagacagggctcattggggcaacaaaaacaagagcgtcttcccaacggatcctttgatttcagggttctctcacggaattggggttccctctttaagtacttccctccttttcaatttctctttttcttttctccctcccctttcatacctccttccttccttttctttccttcccccccccttttttttttggtgagagggtctccatatagccctggctgtcctggaatcgctatgtagatgaggctaggcttgaactcacagagagcacacctgattgtttttattttaaacctaactatgatgattcccattttctctaatctttcaacatactatcagctcaaattcctgatgtagagttaattatctttaaaaaattgaaattctagggtgtttattttccagagaattaaaaagaatatgtgttaactgcttaactgaaaagctgaaaatgttagctaattatggctaacaagtagtgagaatttttttttcagcgttgagtactggtcactttggacttgtcttcaaagtctagaattagaaatttccttgtggtaatggatatgggacctcctgcacatctgtggtttgtgcagtggatatggacacactgtgtgcctgtgatctgtacagtggacatggacacactgtgtgcctgtgacttgtgaagtggacatggacacactgtgtgcttgtgacttgtgcagtggacatggacacacttgtgtgcctgtgatcggtgcagtggtcatggacacactgtatgcctgtgatctgtacagtggacatgggcacactgtgtgcctgtgatctgtacagtggacatgggcactctgtgtgcctgtggttttcacgggttgggttgatgttttttaagctgtagaagtccacggctttagcatttctcatcacaagtgaaaaatgcagcatctttgaattggagacctctgagttggccatacatggaaaagccaggagaattctgtggtccacatgccacaggcatgtgggagggtgggaatgcaccctcctatcttcccgactacatgtgttagacattaggatgctttttggcatctggattttaatttgttggtgacaggatctatatttggggaaagaattgtctgggctaaccttcttcccaacaatcatttgattaaatggttattttccatgcacatctaagtaagatccagacacggtgggtgcctcagactgctgtgtgagccagggttaaggttaacaaaggggcctgttcctcattagtgtgagaaggcgtccctcggaggctagcccataaacatactccacagtggggtaaaggtacagtgacttaaaaccatcactgcctgtgaccaccagcacacctgcaacacctggccaagatgggggctgtgcagtgatttgggaacaatggttgggttgtttgagagtcctggacaacggttgcctccgccttgcaattattctgctagaaagcagagggctctcacgtccttgagttgcagccacctctgtccagccttggaaattcctgttatgtaattttctaaccccctttttgttatcccagtcaccatataacaaagatttccaggacttcaaaatgaaactcaagatcatttctgcctgaaatatgcccatccgagaaatggccagtgctccatgcactctaaatcgtgttcctggaacatttccctttattgactcaggcagccatgcagttggagcaggcggtggattcaaagcggctccgtcttttaacggtgtacttgtgtatagctaccatggcgcactgccgtccagcccatacacattcctttagacatcttttaaattcttttaaaatttattatttgtgccttaatcctgtgagcattcccacagtttacattcttttatccttcagggttctgttgctctgcctttcattttcttttcttgttttctcgagacagggtttccctgtgtagctttggaacctgtcctggaactagctcttgtagaccaggctggtctcgaactcacagagacccgcctgcctctgcctcccgagtgctgggattaaaggcgtgtgccacattattccccttcttcttggctcacaccctccagatttctggaatgttctttgccagatgccgaggcctttccttcaggcagaatttcacaaacacccaagaccactgtttgcaaagaagggttgatacttattcttttgagtccagttgcttgttgtaggagctgggatgtaggaaacatggtgggacccaagtcttaagagtgacagggcgttccggtggctggctgactgtggaggtgtgggcgcaagatgtgttgtgtagtgtgtatggagaaaatggataccgagtcaaactcacgggatgacaggcagccgttcctcagtgaacacatttgtgcttgtcatctgtctctataatggcctcagataaggtaatgcttcctaggttctgaataattggatttctagtcagaggagataagtgaatgcaagcttattggagaatacagccccccccaccccatgagaagctttgatcccatgtccaagctctctttatgttatgagagccccacagcccttggtctgagtatggaatagggcatctgacagtttgtgcgctcttggtacccagccagggcctttccaccaccccgctgtattggtaattactaaaaccatgagttttgcaacagacactttattccctgggcagccagactccaatccttctcactaaggatgtggttcaaaggtatttattggcctaaaaaaaaaaaaaaaaaaaaaagggggtttgagatgtagggaagccacataaggaagtgtcagtatcggtggcccacacatgtgcaaacatgcttcggaccttcatgggaggcctgtttagaaaatagcctgtggctgggtctgccatccctgatgtcataagggttctcaggctgaccttcaggggcataagtgaagaggtctgctttagcgtttcgaaccaattaagatgatttctaagtctctcttaagaaacaaaacaaaaatcaactaaaaccattgaaacaatccttgtgggccacgctcagcaaggtgtttacagagcaacaggctgtgcagggcagagccttgtttctctgttacttaattaagtcacttctgaaagcaatgatgagagccagtgacagtcggagaaaccacatggtgaatttaggtttctctgagcttccgaagaaagcttgtgctctttgggttttaagccctcttttcttttgaagcaggctcttgtcatgttgcccaggctggcctagagcttcttcactctagccatccccctgccccagcctctcagggagggcaacaggcaccatcctctcttcctggtcctctagattttaaactttagggctgaaacattttataagaaagggataagagaaccttattaatttgcatatagggacttggtcacagtctttgctcccccactgctaatcgctgtatcttagagataaaaccattttctttttctggtttgttaagccattctacaacatggtgacacctactgccctttgcacagctacgtcctagcttttgtaatagccaatgaaaacccaaagatccccaaggtgcagcgagttacatgtgggggtgtgaggaacacagccaagtcctcatgatgaaattaacaagccgtgtcgatgccgaggccacccaggttttacgcgtgttaactcagtcctcttcttttgccaggcaacaatgtcatgaggaccatccacggggtaggagagatgatgacccaaatggtgcttagcagaggctccatcttcccagtgagtgtgcccgaagcgcagcccagcgcccacctcagcaagcaggcaagccccagtgaccaggaggacgtgacggtgatggacaccaagctgaaggtcattgagattctacaggtgcgtcctgcagctggactccggcggtgatgctgggccccattggtttctcttaagtgttgttgttgttgttgtaagtgtggtgtgagtgtggtgtgtgtgtgtgtgtgtgtgtgtgtgtgtgtgtgtgtgtgtgtgtggcacaggctcatgtggaccttgtggcaatcctcctgcctcagcttcctgagtgctgagattccagatgttaggcactgcatctggtttcactgtgtaaatgtattgaaacgctgtcggtgtcacgtgagtctgaaatgttattggtctcattttattctgaaaagctattgccccatcttcttattacttttaagtgaagggcagagctggcaatgcatcgcacaccatcgcttctttgcacactcgtcctgtggtttctgtcccttgaaatactctgggatagaatagctgatgtctagcagctgtggagtgctttgagcttggtaaattgctttcctgtgtgtttaatatcagctagtgttgaccccggttggatttttcttcatttaagagagattttttaaagcaggcatgtttaatgatgggattccaatcattttcctgctttcagttgcttggaacttgtttgtgaattccatgttttagatttcctgttgttatgggaaacacaagagttttatgtcagacatgttaggatacgcctataaatctagctctcaggaggctgaggcaggaagatttctgtgagttcaaggccagcctgacagtggaagaccctgcttcacccccaagacattatttaccagacttgttaattgttggttttattactttacacaattacctccctttgtgtttctaagaggctaaggatttttttcacattagcaaagtttaatacctacctttatcaatttaatgagctcagttatttcatgcagcagatccctatatgatttctagcatttttgaggggaggggaggtaagcctgggaagcaggcgtatggtacctttgttgtagtgtttataccagagtcagagaatggagcctgtagctttccggaccgccttgaggatgtgaaccgagtttccccacatctttcatcatcatctaacgtagactgagagctaccagaagtgggtcagcagtcctggcaggctccgtgcattcctcattctaagtaattagatttataatcataaaacatttcccagttcctccagggtttccaaaggccaagtcccaagaaatgttggcaggcttccccaccctgtgttcatggccttggaacttcatatgtaatgttttatcctgaagctgagaaagtactgaaggggccccaggtcagcctcacgaccccgtccatggcatgagggatgaccagtgatgcatgcggccccgttttcaaccgcggttttggcaatggtgcctttcgcagtgacagcgggaagtgtgctgtgtggctgagtctggctggtttctgcctccttccagcacttgaagaattcttttctgaaccgcttttgctgtctgactgtccacccagggtctcccgtttcaaggtgtggtgctgtcaatctgctgcctcctcagaacggccgttcatcaagtccttggtggccgcaggccctggctgctgctggctctctgccagctcctcctcctgggggggggctcccctctttacctcaccgaagaacatggttttcagtgagcgttattttgttcttgccctctgaccttacttattctctctgcctttacaagttcttaaatttatttttagtttttaagacaaggttcgttctgtatccctgaccgggccagagctcactgtgtaatgtaggccgatcttgaactcatgggaatcctcctgcctcagtcccccaggtgctgaggatgctgggattataggtgtgagccaccatgcctggcctttctctgccttgttgtcatctgctttttgttttttttaattttacactatctgcatcttcataatgagacacattagaggagcaaaggttgtgaaattcagttctgtgagttttcatctccaacagacgtgaatgcttcattagtgtttcgtattgaattctctcccccgccctttggacacttgagctttaaaaactgtgtattgagtacctgttgcctagccctgactctgtcctattcactggagtctcttcattgagcgtgtgttgtattcacagcaggttactaagagtcactgtggggtttatctttacttctggactttatactcctcaagagccacatttacaccctggccaccttaaagtactatgttaaaaaggatttttaacttctgtgtgtatgtgtgtgtacgtgtgtgtggtgtgtgcacaggaatgcaggtgctcgcggaaaccacagagtatcggatcccttggagctggagttacaggtggctgtgtgccatctgacatgggtgctgggaatcaaacttgagtctctcgcaagagcagcgtctccccagtcctgtgggcaccctttatacaacaccgtcttccttcctccctggctatcaaatgtggataaactgaagtaagaggagctgacataggctttcttccatcctgatgcagcaccttccaagtgtgtgttgggcgaggatgggtggagatggagggagagagagggggaaaggaaggggaggtatgaagagataaagataagggagagggagggggaaatagagagagggggcatctatccaaaccctggccatggaatcataagaagcgtcatacggacactttcagtgtcttgagagctcgctctcatgggtggagaagagactcaaggtgcagtggacgctgaagaaacatgaaattgcaacagaaaattgtgtgtgacatggtggccatgggccaaagtagtgtgagcactgagagagggggtgaggcctggggaggaagggagggttgtggaaacgagcagaaggctgctgagaacacagaagccagcttttctaaagcctgggctaccacattgtctaacgttcccagaaggaggaggccctttgagactacaggacactggtaatcgctatgctcagaaatccagcccatctcaggccagctgagatttgagcacatccgtccggatgtcttctctgatcccacggctcagccttgcaggtcatctcctaacacaggtgtcccccgttttcccagtgcagttacttgctccgtccaggaaggggttttcaatgtttgggttccccaaggctccctgcagagctcaggccttaagggctacttcatcgctgtccacatctcagccactgaggtgatgataacagaggagacacagacaccatggagaaacccaggcaccagcattccagccatcctggctgtccttgcttctgggcagatgtccccagggctggagcaactccactgcagttaaagctgcaggctttctgggcacaaaagccgttcctgcatctccctctccacaaaggatattgccagggtgtctgaggtcataccagcattacctcttcagacacacaagacgcccctccctgaagtgttcagagaacagtgtggggtgccagatttccttgtttctaaaactcgatgtagaccagtgtggtggcacacacctgtgatccaagctctggggaacaggagttcaagggtatcctctgctacatagggaatttgaggccaacctggggtacaggagaccctgtctcaaaaccaaccacccaaccaacaaaccaaccaaacaaccaaataaacaaccaaaaagaaaaaaaaaacaatcacaaattaattaattactgtgggctttcattagtactgaccaatgaaaacataatcctttccttcattttaaaactgaccaaaacaggtaaacaaccgagagtttatagtttacaaacaaggtctctgattggttcatttggacgattgacagcatggttgttggtgtgtgccacggcttgcattaaaaattcattatgtccacatgggggcacccatatcgcagtgtttgttgtggaggtcagaggacaacttgatggagtttccttcctcacaccttcacaggagttctggggatgcaacccaggttcccaggctttcttggcaagggttttgccctctgagctgtttccccagcctgcgtctcgtgtttaagcgccgtgctgctggctgcggcatcttagcagtgtggcgtctctcagcaccggctcatggaactaagcttgctatgttgcttcttccagttcatcctgagtgtcaggctggattaccggatctcatacatgctgtccatatacaagaaggaatttggggagaacaatgacaatggtgacacctctgccagtggatccccggacacgttgctaccatcaggtaactttgtgataggatttgctcttgcattttatgttctttttaaaatttatcttaaatgttacttttttttttctgagacagggtttctctgtattgttttggagtctgtcctggaactcagtcaatagaccaggctggcttcaaagtcacagagatcctcctgcctctgcctcccgagtgctgggatttaaggtgtgcgtcaccaatgccggctaaatgatactttttatttcttggaaatttcttgtatttatacaatgtattttgatcatatccatccatcactatctccctccaacccctgcaccccacacacacctcacctccctccccagttcatttccttgttttattgttattgacaacccttgaatccactcagtgctgcccgtatgaacatgggtgtgtgactattcactagggtatggtcaacctaccaatagccatgtccccaaagaagagtgactctctcttgctcagcagccttcagttgccaatatccacgctagagttttggctggcctggtcttgtagaggtgtccaaggcttctgtgagttggtgagtgtgccagccacactatttctaacacgggcatctcaaagcactcctctccctttatggactcttgcgttctttccgacacatctacaaagttccctgtgccttggatggtgatggcaggaggctggagatgacccattccagctgagcactcggtgtgatttagactgtgtattttgactggttctctgcattaaccttttcccacgcaacaagaagcttctctgaccagagctgagagcagtacaggtctatgcaatgatataaacatagatatcatgagctattgtgtaggcattaatccctgctgctgtgcaggcttcaggcccaatcaaaaggtggctggtcactcctatagccatcatgccgctattgcaccggtgagcacgtcttggcagcgtgtcagtattgacatacacagggtccggcacacagccaggtgagggttgaagtattttctcccctgggctctgatggggttgactgctctttgtcttgagtccaaagtcagtggtgtcttcagcaattgactcttgtcatttacttttgaggggcaatcaggagcaaacaataatctgtgttgttctgggtgcccccctgggcctctctgatgggtcaataactcacagggaggcattctgtgccttgcactgggttttaatttaaaataacccatgtttgctagaagtagcaccatctacccatgtgggggcttgcattcagattccatgtgtgcatgtgtgtatatacacacatatgtgtgtatgtgtccatgtgtgttgtctgtatgtatatatgtatgtgtgtggtatgtatatacatacatgtatatttgcatatgtgtccacatatgtgtgcatgtgcgtgtatatatatatatgtctatacacatgtgcattttcatgcatgtgtggtgtgtaatgtgtttgcatatgtatgtgcatatacatatgcgtatacgcacatgtgtgcgtatatgtatatacacacacgcatgtgtgaatacatatatagatatatacacatacgtgtgtgtgtgtgtgtgtgtgtgtgtgtgtgtgtgtgtatttaatcagcttacaaaacaatggattgccataagcttctttgtgatccttgattttgctctctgctttaaagaccccaggcacctttcatacctgtcttagaacaaaagtatttctatgtcagaagatgacaatctctcccaggtgaaactgagacagagcagtagaaagaggaacttgctgtttttggcactgtgtccggcacaggccaggtttttggcctgtccccatactgcctccactgtgataggtagaggtgctgttattacaaatttaacagatgataaaagtcagtcaggggagtgacttgggaagatctgtacatttgttagtgttgctgtgatgaaagcaactggagggaggaagggtgacaagcagttcagtctggaaggggcagcaaggggcggggtgcgaggtgactggtcacattgtctccacagtcaggaagcagggaaagttgaatgctggagctcggttcactttccccttttagcacaggaactcctgtggtggtgccacccacattcagggggcccttcccacctccatgaaaccttcccggataccctcacagacacagccagggtgggtttccatggtgattctaaattcaggcaggtccacagtgagggctaccacagtcatcaaagccccgggcccctgaggcctcttcagcgtcagagtcagagtcttttgcacattttgttcttttggtgaaaatctgagaacagtgttcatgcctggatcaaagagcagcgtgaagtgcagctggcagggcagggttttcggggaagccatggttagccggagaacaaaggggaagggctcccgaaggctcgcctgtggtggtgccaggctctgtgcctttccctcaggaatcccatctcacatttagacattcgaatgtctctgagacttggagcataacccaaagagcacagaaatggctgtgaaatttgaggctatagaaaggactttgtgaagactaagaaatgttagctcacctttttcctggttgggccaggtcggtcttggtggtctataaaccacatcttaggatatagacagccagttagcaaagctcttctgagacagcagtgcagataggaaactcctggacagtgttaggaaccacgtccttctccagccatcagctggtcaggcaagaacaggccattgcctgctagtttagtgagaatggggaccagaccagttgcctcgctacccacctctgctctgcgggcagccttccctgcagaccagcagccacccttccgcctaggcgaggagccactcctggcacccccaacacagcagtttcccagaagtgcagaaccccaaagggctgtttccaggaatgatcaggcagaaccagaaagtcatgctggcggctgcattgacagaaacataacagttactggctcccagaagccagacttctggaaatacaagctctgagtgtcagtaaagtacccaagcaaaggttaaaggcacgccagaaaatcctctggtggagtctctctctctctttgtctctctgtctctctctctgtctctgtctctctctgtctctttctctttctctctcataggatttccccctctatttgtatcttgatctcttttcatgctctagatatgagaaatacataatctatcatttgaacatgttgtcttagtaaaggtatcttcaatatggtggtggcagggcatggtgaggacttgtgattgggtcacatggcaaatgaccccaccccattctacaagaaaaagagaaggaatttcttttattttgagcttgtttttattgagctcctctccctttctcctctcttcttcccttctaccctccctctgcccccatgctcccaatgtactcaggagatcttgtcttgtttgcccttcctaggcagatccatgtctgtctgtctttgttacctaggttctctggagttatggactgtaggctggttgtcctttgctttatgtctaatacccacttatgagtgagtacatattatatttgtctttctgtgtttgggataccacacccaggattttttttttctagttttatccatttgtctgcacatttcaagatgtcattgctttttattgctgagcagtactccatgtgtaaatataccaccttttctttatccattcattggttgaggggaatctaggttgtttttaggttctggctattatgaataatgctgctatgaacataattgagaaaatgttcttttatcgtgagaatgcatcctttggtatatgtccaaaagtggtattgctgggtattgtggtaaacagattcccatttttccgagaaaccacagtactgatttccaaggggctgtaaaaatttgcacttcagccagcaatggaggagtgttccccttactccacatccgctccagcatgagctgtcatcagtgtttttgatcgtagccattctggcaggagcaagatggtacctcagagatggtttgacttgcacttctctgatggctaaggatgttgagcacttccttaagtgtctttctgctgtttgagattgttctctcgagagctctcaatatctgtaccccatattttcattagattattttgtagtttgatgtctagtttcttgagttctttatatgttttggagataagccctctgtcagatgtggttttggtcaagatcttttcccattctgtaggaagtcattttgtcttgttgactgtgtcctttgctttgcagaagcttctcggtttcaggaggtcccatttattaattgttgatctcagtgtctgtgctactggtgttctatttaggaagtggtctcctgtgttcaaggctacttcccactctctcttctttgagtgtggttggttttatgctgatatatttgacccatttggacttgagttttgtgcatgggggtagatacagacctatttgcattcttctacacgtcaacatccacttatgccagcaccatttgttaaagatgccttgttttttccattttataattttagccttttttttgtaaaaaaaatcaggtgttcatggttatatggattgatatcagggtctttgattcgattccattggtctacctgtctgtttttgtgccaataccaagctttttttgttactgtggctctatagtagagtttgaagtcagggatggtgatgcctccagaatttcttttattatacaggattgttttggctgtccttgttttttgttttttcatatgaatttgagtatcattcttctgaagtttgtgaagaattatgcttggattttgatggggattgcattgaatctataggttgcttttgggtaagatttctatttttactatgttaatcttacctatccaagagcatgggagatctttccattttctgatatcttcttaaatttctttttccacagatttaaagttcccgtcatacaggtctttcacttgtttgattagagttacccaagatatttaatgttatttgtggctattgtgaaggctgatgtttccctgatttctttcttggccctttatcatttgtatataggagggctactgatttgtttgagttaatgttgtatcctgtcacattactgaatgtgtttatcagctgtaggagtttctggtagaattttttgactctctcatgtatactatcctatcatcagcatacagtgaaagtttgacttctccctttccaatttgtattccctttgaatttttctccatttaatttgatgttaggtattggcttgctgtatattgctttattatgtttaggaatgttccttttatccctgatctctcaaaaacctttatcatgaaggggtgttggattttgtcaaaggccttttcagcatctaatgcaatgatcatgtgtttttttctttcagtttatttatgtggtgaattacattgatggattttcatacgttgaaccattcctatatttctgggatgaagcctacttgatcatggtggatgattttttcatgtgttcttggatttgatttggcagtattttattgagtatttttgcattagtattcatgagggagattggtctgtagttctctttcttagttgtatctttgtgtggtatcagcataactgtggtcttataaaagagtttggtaatctttcttctgtttctattgtgtggaacaatttgaagagtatcgttattagctcttctgtgaaattcaggcagaattctgcactgaaaccatgtggtcctgttttatttctggtggagagacttttgatgactctttctattattttaggggttataggtctatttaatttgtttatcagttttgatttaattttgatatatggtactcatccaggaaattgtccatttcctttaaattttccaatttagtggagttttgaagtatgacctgatgattctctggatttcctcagtgtctattgttatgtccccttttcatttctgattttgttaatttgggtattctctgtctgacttttggtttgtttatcttgttgactttttcaaagaactaactctttgtttcattgattctttgtattgttctctttgcttctattttattgatttcagccctcaatttgattatttccagccatctactcctcctgggtgagtttgcttctttttattctagagctttcacttgttctgttagttcactggtgtggaatttttccagattctttatgtaggcatttagtgctatgaacttttctcttagcactgctttcattgcctcatgagtttgggtatattgtgcagtcattttcattgaattttaggaagcctttaatttcttttttttttttaatttcttccttgacacattggtgattcagttgagtattgttcaattttcatgagtttgtgggttttctgcagttagtgttactattgaattctaactttaaaccatgatgatctgataagatacagggggttattccagtttttaaatgtctgttgagatttattttgttggtgagtatgtggtcaattttagagaaggttccatgagatgatgagaagaaggtatattcttttgtgtttgggaggaatattctatatttctgttaagcccatttgagtcaaaacatctgttagttcatctatttctctgttaggtttctgtctggcagacctgtccattagtgagagtgggatgttgaagtctcccactattagtgtttcgggcttcacgtgtgatttaagctttagtaatgtttcttttacaaatgtgggtgcccttgtatttggagcacatatgctcagaattgagacttcatcttgatggatttttcttgtgacaaatatgaaatgttcttcttcatctcttttggttacttttagttggaagtctattttgtcagatattaggatagctatccctgcttgtttcttaggtccatttgattggaaaaaatcttttcccaatccttttttttccagacaggatttctctgtatcgttttggagcctgtcctggaactcgctctgtagaccaggctggtctcgaactcacagagatccgcctgtctctgcctcctgagtgctgggattaaaggcgtgcaccactaatgcctggctcctaatcctttactttaaggtaatgcctgtgtttgtagttgaggtgtgtttcttgtatgcagcagaaggctggattctgcttttgtatccattctgttagcctgtgtctttttatcggtgaattgagactattgatattaagggatattaatgaccagtgtttgctagttccagttattttgttgttgtgcatacatttccatgctttgcaatttgctgttatgggattatcttttgcctgtgtttttgtgggtgtaactaatttccttgggttggagttttccttctagtttattgataggtattgtttaaatattgttttgacatggaatattttgttttctccgtctatggtgatggaaagctttgctgggtataatagtctgggttggcatccatggtcccttagtgtcccttagtgtctgcataacatctgtacaggaccttctggctttcattgtttccattgagaagtcaggtgtgattctgataggtttgcctttatatgttacttagccttttcccgttgtggctcttaatattctttctttcttctgtatgtttagtgttttattattatttggcgagaggaattttttttcttttttggtccagcgtatttggtgttctgtaatcttcttgtactttcataggtatgctcttctttagattggaaaagttttcttccatgattttgttgaatatgttttctgtgtctttgagctggaattcctctccttctactatccctgttattcttaggtccagtcttctcatggtgtcccagatttcctgaatattttgtgttaggaatttgttggatttaacatttcctttgtctgatgaatctattacctctattgtatcttcagtgcctgagattatctttttcctctcctgtattctgttgtttacacctgcatctgtggttcctgttcatttacccagattttccgtttccaggatttcctcagtttgtgttttctttattgcctctatttcattttttaagtcttgaactgtttgttgcctttgcctgtttgattgccttttcttggttttcttttagggatttgttgatttcttgttttttgtttgtctttccctccgtttctttaagggagtttttcatttcctctttaggtgcttctattatcttcataaagttgttttaaggctattttcttctgcttccactgggttgggatgttcgggtcttgctgttgtagagtccctagtttctggaggtgccatatgtctcttcatgttgttgaatgtgttcttgtcttcttgtctatccatctcttcttctgatcagcacaggtgcagcctgtgcttcagggcatccctctttctccagttggtgtagttgggggatgccactctgttgattgctcctccaggagcaggcagggctgagtcactgatggctgctcctctaggtgcaggtggttctgatgctccagaggtcactaacgctgctgggtgtcacatacagagaatggcactggaggctggatgggacacaggtgctctttcccagaggagcttcttactactgtttctggaagccaccgctgtcaatgcttcagcattgcccagttcatgcactgtctgctccctggttgtttgtgacctgcctgacccttcctctccccagttggtagggaagaaggaatttcaaatgtagaaaggtcacattgaaggaggaacagagtggctctttacatggattttaattccttaaaaaatgcttttcccttgggtctggagagatggaccagctgtcaagagcactggctgatcttgaaccctcattaggttcctgacatcttcatggtgtctcacaactgtatgtagtcccagggcatctgagatccttttctggcctctgtggacactgcacacaggtggtgcagagacaaacatgcaggaacagcatccacacacatgaaataaaagtaaaggagaaagaattgttcttctgtgccattagcagtgcaatattgtgtgtttttatggagggacacatgtatatttgacttatcaaatacaaacatacacacttagaaataagagtgcctttgctaagatggctgttgatcggttaacacatctgatggcagtaacatatagtgtaaataatataagcacagcttatattaaaggattgaagagtgagatagcacatttgtagcctggattcaatatatagcatctaaatacacacacacacacacacacacacacacacacacacacacacacacacacacacacacgcagaaactgcaattaagatgttcaagtttgttctagttttgtttttgttgttgtgataaaatactctggtaaaaagtagtttaggggagaaaggggtttgtttcagtctatatattcaggttatggtctatcatgacagggaagtcacagaacatgcccttgagagaatgggtcatcatatcatgtccacactcagtcatatcatgtccacgggagagagaagtcattgcacacatgcttgcttatttgtgctcagcttgacttctgtatagttcaggacctcctacctagggaatggtgccacccatggtgggctggatcttcccacatcaatgaacattagtaatcaagacagccccacccacgtgtctacaggctaacccaatatagacaattcctcattgtgattctacattatgtcaagttgacaaagcgccatcacactgattgagtggaactgtattgtaactttctgagctattaatgttcggtgtcacaaaaagtgttaaaataacatgagttaaaacaagatgaagactctccctgtgtgtcttcacagctattgttcctgacattgacgagattgcagcccgggcagaaacgatgtttgctggaaggtactgtaatgaatctttttatcttacatgcgagatacctagaattttgtttagtttgttatcattcatctttttgtgcctggttagataccccagttgctgctaacataatttctgccagaaatgaaggttggaatttactctagacaccttaaacgatgggagaaaagagatccatgtatttaacatcctggaattcttagcttttctttccttagatgatggcagcacacagatgccctctagctcccttgacagaaacttgttgtatcttgtaacacattacgtctcagagtcttagatctctgtggcaagaaagtagcatcttttgatgttatccttaactttatgcatgagaaaccaggcatttcttgccatttagaagtgtccacgatggaagaaaataaggtgtctgatgtgaccactctcctttgcttgccacgtcctggcatgtattgttgtcaagtttatttttcagaaatgaaacaatagcagtcaaaatgagaaagtaaatgtcagctagaattactgagattcatttttattacagacctgaggtaacctgaggagatagaactgtccacactgaactccctactgcctcttttttctcagagaggggaaaaagggggctggagagatggctcagagtttaagaaagggggaaaggattaataattaacataactgtaagatccacggtttcatagtagcctgggctacgtagtgagaatctgtgtaggggaggaggaggcgggaggagggaggagggaaggacagagcgcccagatttattgtttagtgaacatttggtatagctttatttttctactgttatgatttcctattgaagtattttattattctagggaagaaagataaatccagcctatgattttatcttaagacacagacatgaactgcttaatgtcactttggccaaagatggctccaggtgatagatcgatgaggatagaattgtgttctataacatggcaagaactgaaaaattcccagagacaagtgacttcatagccatcggttgttagattgcagtgtgttagtgtctgtggaggggcttgaggaaagcaccagacagccaactgtgtcagtgtgtggcgtgtgcagccacacgcagcatgcagtacttgagagtgactgttgctggcttatgcattgaatatatttttaaccattattttggtgtgtctgtatgtgcaggcacacgtgtgtgcatgtgtcagagtgtgtgtgcatgtgtgagagtgtatgtatgcatgtaactacgtgtgcatgcagtgtgtgagtgtgtgtgcatgtgtgagtgtgtgcctgtgtgtatgtgtgcatgtgtgtgtgtgtgagacagtgtatgcatgcatgtatgcatgtgtgagagtgtgtatatgtgtgcatgcacgtgtgagagtgtttgtgttcatgtgttcatgtgtgtgcatatgtgagagtgtgtgttcatgtgtgaatgttcatgtgtgagagtgtgtgtgcatgtgtgagagtgtatgtatgcgtgtaactacatgtgcatgcagtgtatgagtgtgtgtgcatgtgtgtgtgtgcctgtgtgtttgtgtgcatgtaagtatgtgtgcatgtgtgtgtgagtgtgtgagacagtgtattcatgcatgtgtgcaagtgtgagaatgtgtgcacatgtgtgagtgtgtgcatgtgtgcatgtaagtacgtgtgcatgcgtgtgtgagtgtgtgtattgtgagtgtgtgtatgtgtgcatgtaagtacgtgtgcatgcgtgtgtgtgtgagtgtgtaagtgtgagtgtgtgcatgtaagtatgtgtgcatgcatgtgtgtgtgagagtgtgaatgtgagtgtgtgtgcatgtaagtatgtgtgcatgtgtgtgtgagtgtgtgtattgtgagtgtgtgtgttcatgtaagtacgtgtgcatgtgtgtgtgtgtgagtgtgtgtgagtgtgtgaatgtgtgtgtgcatgtaagtacgtgtgcatgcgtgtgtgtgtgagtgtgtgtattgtgggggtgtgtgtgcatgtaagtacgtgtgcatgcgtgtgtgtgtgagtgtgtgtattgtgggggtgtgtgtgcatgtaagtacgtgtgcatgcgtgtgtgtgtgtgtgtgtgtgagtgtgtgtattgtgagtgagtgtgtgtgcatgtaagtacgtgtgcatgcgtttgtgtgtgagtgtgtgtatgtgtgagtgtgtgtgcatgtaagtacgtgtgcatgcgtgtgtgaacgtgtgatcagcagcatctcgtgccccttgtctcccaattgcatcatttctcatgtgctttgtttaaccttgtgttgctttgttcatcgagatcctagattccatacattataatctgtctgtcatgtatgtatcaatcacctacttacatgtctaaacatacctgccatttaacatctacctatatatatatatacatatatacatctgcctatcatctatgtatatccatgtatcttgtctatcaatcacctgtctgtgagtgtctgcatcgatgggtctgccatgcgccgtatacctgtctctgcgcgcatcggttttgcgtgtcggtcatttacatgtgcatccatctgctgcctgtgttctgtgtatctgtcatctgccatccgtctctttcatatccatcttcccccacccatgtaacccatacatgcattaacacaggtgtgtgataggctctgtaggcttgcgtcatgccctctgtagtgcttgcccaaccacagtcatctaagggttacatcccagagcacagcccggcagcagcagcacatgctccagagagatctttcaccccaggggaccctgtccccagtctcactgtgccaccaagcacacagagccccgtggagatggctgtgtgtttgtcactgtccctcaccgcttgccgtgtggtggtctcttgggctccaggctgttggtcgatattattgataaaagctttcgcagaaggcggctcttctagaagagtggcagggcaaggaggacaaagagggatagtgggaaaatttgaactagtaatgaactgttatgaaaatgtcataatgaaacccattattttatatgctaggtaacaatgaatcgaaaatgatgtagggatcacccagtgcttgtttttcctgttctctggtgattaactcttgagactgactgaggaaccttctttgttattgttccctcatcaattgtataagattaagaagtaacaatgtctcttcttttttgggaaaatgagggtttaagtttaaaaacacaggtataacttcagtgaatttaatatagatatcatgcgatgtgttattttagagtttcttttggttttacaggaaggaaaaaactccagttcagcttgatgatgaaggaggcaggacgttcttgcgggtcctcatccacctgatcatgcatgactaccccccgttgctctcgggggccttgcagctcttattcaagcacttcagccagagagcagaagtgctgcaggcctttaaacaggtgagctggggctgggtgcctgcttgccgagctcgctcgggctctgggttcagttctcagctctgtacccaagaaaacgaacacccgagatggagggccctggaaaaggaacacctgagaattcctggagttctgaaggtgtttgtagcccgtctgatggtagctgcagatgaggctgtgttccttggatcctctcttgctctgtagtacaggctggctcagaattcagttcattgctcggattgaccttgaactcttggcaatccccctgcctctgcccctggagtgctggaattgcaggcgtgcactgcaatacctggcttgttactttgtgttctgaaagatagatgtggtcctgtctgtgtgcctagacaggagctgcttcagaatgagtctcccacaggtgatcttcagtcagtatctttataaaaatgacagtctctagaatttaggaagtgctgctggaacaataacctattagaaattttgttgctgctgtggttattttgactacagaatttaatgatgcacctggcaagccatagcttcaaaataaatattttgtgattaaaaatggagaacatccaaagaaaggaactttaatgggggatccatcttgtcccctgtgatgggatctagtctatcttctgtgatgggatctagtctgttttctctgatggatccatcctgtgccctgtgatggggtccatcctgtcccctgtgatgggatctggcctgtcttctgtgatgggatctggcctgtcttctgtgatgggatctggtttgtcttctgtgatgggatctggtctgtcttctgtaatgggatctggtttgtcttctgttatgggatctggcctgtcttctgtgatgggatctgggctgtcttctgtgatgggatctgggctgtcttctgtgatgggatctagtctgttttctctgatgggatccatcctgtgccctgtgatggggtccatcctgtcccctgtgatgggatctgggctgtcttctgtgatgggatctgggctgtcttctgtgatgggatctgggctgtcttctgtgatgggatctgggctgtcttctgtgatgggatctgggctgtcttctgtgatgggatctgttctgtcttccgtgatgtttggattgcacattaatctcacagtgattacttgcaagtatgggtatctcactgatgttttgtgtttagtggagtgtgaacctgtattagcagttttgaagatgctagcagatatgaagatatagatgcatatgttttacatgtatgtgccatgtagtgtgtataaactataaattgtatggtggtctcaagctctgaaactgctgtttatactagcaaacgtatattgtaaccattaatattttcttccatgggtttttatactttgacttttcaaacagatacaagtctagagaaacctcagaaaaatgaacttgaacaatgaaattagagttagattatcttgtaaaagaagatttgtttactcttgatttatttatatgggtatttgcactcatgtaagtatatgtaccttatgtgttcagtacccatggtggccagcagagggtgtcgggcctccgggaactggagttgcaggaggttgcgagcaccatgtgtgttttgggaactgagtttgggtcctctgtaaatgctggaggtgctcttaatccctgggccgtttctccaacccccacaactttatgttaaattacttgtcagcattttggaagctttttgagagcacacatctaagaattccttttcgcgtgtgagcatattggttagagttcgtgaatacttgcaggaagattttcagacggaatacacataagtatgcgtaagtgttcgtaagtgttgaatttcatctagagagtggctgaagatgggatttcgggtgtgcaggagccagggacacagaaggctgggagagcgctctaagggtgaaactctcgtgtcctcaggtgcagctgctggtgtcgaaccaggatgtggataactacaagcaaatcaaggcagatctcgaccagctcaggctgacggtggaaaaatctgagttgtgggttgagaagagcagcagctatgagaatggagagattggcgaaggtcaggccaaaggaggcgaagagacaaatgaggtttgtttccaaggtcactttcaggaagaaaattacttatttctgattgagcgcttaattgaaatgtgtgtctgtgcaccgcgcctgtagtacccatacaggccagagggggcaccataccccccgaacgggggatacagagcgttatgagccgttgtatgggtgttgggaaccaaacgagggccctgtggaagagcagctgctctcttacctgtgtttaacgggggggggggggtccagcccccacttttttttttaaataaaagtgttactggtaatgcttttatgaaagccagttaccaccgaagtcctaattggtggtttctggaaagaagcttatactcctcaggagcatcagtggtgtggagaggctcactcagcacaggtctgggagtattgcttcgggttgtagattggcagcacagaatgtggcaattaaatattaacattaaacattagaaatgccgaggagttacgacgaggtggagttgaagtggtggcatcccacctcaggtctcaggatggtggcttatctgtaattcttcactttaccattttagcattagtggaatatagattttctagtccatacaaatttgttttatgatcagttagggccatggggtggtgacacgataaataaaagacccaccgacagatactggggttcaaacatcaagctgacggtcagaaaagcaaagtagctggccactatctctcacctcaagctcaggctaaaagggctgatccatgcacaagctcttcaccaagcctcaaactgctgcctttcctcagcgtggctggagaatactgagacttcaatgtcttcttgtccctcttggtactgagccttcctatcttcagtgtggctggagaatcaatgcttcctatccccaatgtgaatgcctgatctgagaccctgctcctggtttatatacctccctagtgctgggattaaacgcatgtgatcccaggtgctgagatcgtctttgtgtgagctgtttctctttaggactggatcactcttgtgtaggtctgggtggccttggaatcacagagatctgtctacctcttaatcctgagtcctaggattaaaggtgtgtgccaccacctcctagattctggctactagtattaaagctgtgtgtcaccgctgcctgatctctatagcttgaggctgactttgcttttctgaattctcagtcaagctttaataaatcatgaataatagatcactacagggtggggcacagattcttccataattcatttctgaagtaaggaataagttgacatttctttagttcttcccttgtgcacactgaagagcaaatacttttgtgtgtggaatctccttttaaatgtcacaaaaaaactttggggatggctgtagggctgcctttttaagtttaataaactaaggcttggagaagcccagggctctctcaggccttgaatcggtgactcagccaacatttggatgataagatccaggttctgtaagattgcactttctgacataatgttagcgagttgctatgctttcacaaattacaaaacccctttgttttgaaaaagtcatattttgtatgtgttctgggaagtttactgttgcttttcatctgacttacacatacctctttgagttatttcagtagaagtcttcaggtgggctggagaggtggctcagcaattcagagcactggctgttcttccaaagggccagggttcaattcccagcaccgacatggccactcacaactgtctgtaactccaagatctgatgccctcacacagacatacatgcaggcaaaacaccaatgcacataaaaaacaaaaattattaaaaaaagaattcagatgaggtgtgatggggagatgttgttacttcctggccttcgctgtctatcattaaggactgtggggtgagccctttactgtggcatggagagcccgctgttctcttggacacttctcaggcactttccatgcacataagaaagaagagggcgtatagatggactgcatatattctcaaggtaaaactgtgtagcttgtggcgtagagaactggttctctaggggattcaaacaagtgagtaatgaagctgacacttatttgctgagttccagatttattgattcgggaagtggagattactttaggtatgttgattaggaggtggtttaaatatgaggaattaagtatttggaaaatctggagtgtggaggctgccattggactgttgacttgaaggtcaaatgatcacagtgttgaatggagacgccacttgtgaggcaaaggctgctttgtggccatgtccgtggctgcatctgccaccatagactccctctgtgaatgtatggggcgtgacagtgaatacgaatctcttaggaaattccatgtctgctggaattttccttttggctcccacaattcctgggagatgccttgtagtttcctcctggcctctaggttgcaagtgagctcatctcactggcttgggctgaattggatttagaatggtcactgcaggggagctggagagactggctgcaggcagagctaagtgaaggaagacaacctgatttttttattttttcttgtcaaactgcagttttatatccttaaaccaatcctttccccattgttaaaagacccacattgaagcctaataggcacaattctgctctctgttcccataagttcatcatttctaggttacacataaaattgaaattgtgtgacatttgtcttccagtgaaaacagcctgatttaatacccagagcacagatgataatacagagacgatcagtaggggtgtgagagggttggaaccagataccccaagatctactgctcagcatatgtgcaactcagagtaacttgcttacattttccaagatttatttttatcatctacaacatggacagtgcagtatactgtaaggagtcagtgagccagtccttggtgatgatgatgatgatgatggtgtgtgtgtgtgtgtgtgtgtgtgtgtgtgtgtgtgtgtgtgtgtgtgtgtgctggttaggggttttttcctgtcacttgaatacaatcgtgggtcatctgggaattgggaccctcacctgaaaaaacaccaccagttagcatgacttcagtggacaatcaatcattagcatggcctcagtggacagtcagttaacattgcctcattggtcttgaacaactgacaatatgaatagtaagttgacattagataccagaaaaagcaagcagtaagacccttccttccttccttccttccttccttccttccttccttccttccttcctttctttctttctttctttctttctttctttctgtgtgtatgtcatggatatataagtgcttttacaggcctcttagaactggagttacaggctgttatgaactatgaactgcccaatgtggaccctgggaactgaacttgggtcctctgcaagagcagcaaattttcttaaccatcgagccatctttcaagcctgtgcaaccttaatttattgcttcaggcttgtcatcatggaccagtgggcttaattctgaggctgcccctgaccatatcctagcagcagcattctggtgtcaaatccgtgaccaccacctagaatgaaagggtctttctgagtctcctgtttagggacgagagagcctgtcccaggagtccttctagtaccttctctgaatcctggacacattttaccattaaacctgtgggctaagacatctgtgccaattagtgtttattgtcaactcgacacaagctagagtcatccaggaagaaggaaccttaactgagggattgcctccatcagactgacctgtggacatgtttgtgggaaattgtcttgcctattcattgacggagaagagcacagtgcactgtgggtaacaccatttctgggcagggcaggtggtcctgggttatattaggaagccagctaagcatatacctgtggagggagccaacaaggggcgttctttcatggtttctgtttcaagttccctcagggatgacctggagtgtatgctgaataaatcctttgccctttaagttaaatgtggtcagtgtttaatcacaccagtaagagccagacttggaacggtgcgtatcttaagagacagaacactactggtaataagcccctgtgccttagactactcccacgagttttttagcttccttgtttaatggtcttctcctatgtggttgcatttctgaaacacaagaaatgcatgggagatagctcgggctgttttggatctgctgtctccaatccttgttgagtgcagcaacagttcatctgtatgcgatagtctgcattggtgccttgtcacacatggctttttaatcagctggtggcggacttctgggctctttgcagtgctgatgtctgaaggaaatgcgctatcagaagcggcgctatgttggtctttggattccaccagtggacttagaggtttgttttagattcatcgtcttatttcttccagtttagataaagctgagttctgttgaggcaggtaacgagttcctgtttgttcatgtgtacctgacaatgatgctggactggggaggtggctaagtggttagcgcacttgctgcccaaatgtgagaggcaggtgtttggatgtctataacctatgtaaaagctgcagggcatggcaggtggcccataattccggcatcaaaagacagaaatgtcgagtctctagagcaagctggctagccaggctggacacatagacaagctgtggtttggactgacaaaccctgcctcagtgaaaaggtcagacagagagcaatggagatgattccagacaacaccccggccccctcgtgtaactccttgtcctctgcccccatggcggccgtgaggaggtttgctgcgtgttgaaacagttggatcttaattttgaaactccagttaagtatatgttaaaccttgttagtgtgcctgttggtaacatgtcaatataaatatgtatctgttaattttagtttcatctttctcaagtctgttatcttgcagtaaacactgaatcatttattggaattcatgcatatatgttttcacccacaacttatttaaagtttaccataccaaatgaaaatttaacttcagccattgtacgttttcataactgaaaattaacctttttcacatttgtttggtggtttccatcagatgttattgctttttacattttctgattcttgttacttgatattctgtatactgtgaagtaattgggaggtgcttttctaatttttaaaaattttactttttaagatttgtttttatgcacagttatcttttgcctacatgtgtgtctatgtaccacatgcgtgcctggcatctatggcaccagaggaaggcatcagatcccctggacctgtgttacagggcgttgtgagctgccatgtgggtgctgggaactgaacctgggtcctctgcaagtgtgacaagagctcttaaccgctgagccgtctctccaaccctacttggaaatttctaagaatacttatttcattatatttctgctcatttctgattatgaattcttacgtttcctttacagacacattttcagaacagttttggtttagagagaaattgcacgtgactagcagggggcgctcgtacacttcccgccttgctttattgagggctcactgtctctgcagcacatcctacacacggttctgagaaaatgaatactgtcacccacaacagcacccgtagagtagatccacggcccggacagccccgcacttcacccatccacctcgcgtctcggaggccccggagactctgaggtttcacgttttgcagaatgcagtgtggttgggtcacatgacaacaggcttctttgacttaatgtgtttgtaacgttttctcacatcccatgtagacagactacgcttgtctctgtgatactttgcgtgtgggtgttctactgtttctgagtacatgtccagctaaggatgcctttttggttgtgagatattacagctccttgcttgcagattctgagcttgcgtgtttttatatccagtagacagaagtagatttgaagtagaaagaagaaagttctttccttcctcgggcaattgtagttctccagactgttgccagggggcgctgtcagtctgagcccacagacatcctcagctgctaacctgtctcaagtcaggcatcttgggtttagagcccagaaagttgacactttctcagagcctgggtcctgggctgcagagctaacagtggcctttgccttctggatggtccgttcacagcctgtagattggagccctctggcaatggctcttgcttaggtgatggaaggggcaggagttgtcccagagactggaaatgttgtaaattacgtttatatccagaacctagcttctttgtaggaaggcatgttctcgcagaagttggggcctttagtagggttgttctattgttattacaaaggtgcattctaagtgcaattcctctgaggcctgaatgtaatctacagaagttctgttttgtaacctcattaaatacggactttgggggtctctttatgaatgggaattctagtcccagatcttggagtgggtttttctttctgtacaggagcctaagggggcacccctgagactgtggccagagcaaaagccacgctgcgtgggtgccccttgtccttctgtggctgtttcgctgactcactactgcggtggttccctttgatgtttgtggttctgtggcttctggccagaattttcatctttcttggcagccaggcttgccccagcctcctcccccctccctgtcctgccctccatattaacacttagactctaggacagtcgccagcatgggcgtcagccccgaggggcatcagtgactccaggacttcttaccgctcctaaatttttataaactttcatggtttctatcttcctaccaaaaagaggcatcttaaatattttatctggatgctgtctggaaggggctgctcacattctgtctgacagttgtgagcaatggtcagctcttctgtgttttcatctgtaggtactggtgttggctatgggccatgtggaccacagctgagccccacccctgcccttgagtagagtgtttgtgtttccctggagtagagtcttcctctcagactctctgcccagtgtgctatgggtccctttatccacatgtaacccccttagctggcacacagaggaatttctcatttccattcctaaaatatgaggtctggaatccatctgatactccagatatggcccttgctctgcagaaacggcacctataaaacagtgtgagaaagtccacacacatagcacaggcttgctttgtattcaagaataatgacaacaggactaagtgattcatgttagaaatggctgggaattgggagagttccaaggaaggagaaagcagattccagaaggcttcagaagaatccagacaccccagaaggactaggactaatgcgagaagcactaggagccttttgcacatgaccaggtgtgagcctatgaatgcacagggggaagaggtgatggaaacataggcaaatgggtggacgcagaagcctgaagcacccatgtaaaatgaagtaatttcaggagaagaaagaaagcatgtgagaagcgacagtgctaactcttacacagatgaggccggatggtggcggcacacacctttaatcccagcattcagtaggcagaggcaggcggatctgtgtgagttcgagaccagcctggtctacaagagggagttccaggacagcctccaaagctacagagaaaccctgtcttggaaaacaaaacaaaacaaaacaaaacaaaaaacctcctacacagattaataatctacattgtgagtgaaccagcgtccaaggacgctggtaacatacggatgaaatccatcctggtgtcagtgggaatagcccatagcaggcagcgtgcactctagcaggcggtaatagccagtagcagtcagcatgcactccagcaggcggtgggcataacagtcctttgtgtctctgagtgtcacagaggctgtaaacaaggcctttggtattctggacaaatcagagccatcgggctctcagctgcctaagtgttaagaggcaatagagtgactgctagggtttgtttatttaataaaaaagtcttcaatagccgaaagtttcaattttttatttgtttattttataagtgatactattaaaaatatttacactcctacttttaagcccacttttaagtttagatttcttatcataatctgacagcacaggttctttaagggctgggggaaaacatttcattttaaaaaaaacgaatattggcaaataaatgtttttctctgcgatttatattgaatatattaaatctaaaaagatgcttatgttatttttttcaacctgataaaatgctcgtgcagcctctcatcaaagtaaagcttagcagtgatgaaagtgaacttaattacaaatggcccttcatctgccattcagtgagagatttcaacagaatttaaacaaacaagaattggtaagcatcgctgtaggcaaactgtgaaatacctatctttgtgtccttgggaacttcaaattaccccattgctggaactgatctctaacgatcacagagaaggggacaggttccacacctagtgtctgtcagccatgttcccgagtaccccagcattgcccttatcctctcccaaatgtgtcttctggggcgtgggctctgctggcatccaaaggcttacaggctgggggacagcctgcggcagcatcaacaaatcactaactcatcaccttcaaatatgtgttttctaaatttagaagggagattaagtcaggaaagtgtctctgtgggttaagtcaggattgcccttcctgctctcacctctttatttagtctgtgaagcaggtcacctgggcgtctctgtgttccacagagaaaacccataagggttatttccttgttaattatccccaccatgactttgtttctctgttttttaactatttctttctatgctcctgtgtagtttccagcatttccttttactttaaaacattgtgtgtgtgtgtgagtatgtgtatgagtgtgtgtatgtgtgtgtgagtctgtatctgagaatatgtataagtgtgtgtatatgtgtgtgtatgtgtgtgagtgtgtatatatgtgtgagtctgtatatgagaatgtgtgtgagtatgtgtatgagtgtgtatgtgtgtgtgtatgtgtatgagtgtgtgtgtgtgtgtgagtgtgtatatgtgtgtaagtctgtatatgagaatgtgtgtatgtgtatgtgtgtgtgtgtgtatgtgtatgagtgtgtgtgtgtgtgtgtgtgtgtttgtgtgtgtgtatgtgtgtgtatgtgtgtgtatgctgtctctgcctcctcagtgctgggattacaggcatgctgttgtgcctggcttccagttttttggtaagagaattacttactcactcaatgactttagggctgatattaagcacccattttgttttgtgactaggggaaatatttccttttttcaggtttcctagttaggtctttttaatactcacccagtgtacatctctgtctgttcctttgctctgaatcttttgttgttcttttggtggacgtgtggttcagggaatggaatgaactggacagtatcctcaagggcaaaagtctggttgtctagaagaggggctggcattgtttgggtgtctgtcctgctctttcccaagcttcttcagggacagttgttgacatctttatggtgcggtctgggcattttcatggaggcactccattgtcgatgtgtcctttaaaaagttccagtggggatggagagagcagttccttggaaaccagacccacggagcacatctgtgttgcctctagaggaagggctcaccttctcttgctcatgcttggcttacagtccctcttcctccgagagccacccttatgtgagtcagggatgctttgggctcatcctgaccaccgcagagtgttatccttcagctctgtgaaggctttaacgtgtggatgttttacagtgtaggagagaggcaggtctgacggtatagtacagtgtgctttcgaggcacaagcggactggagtcaggctccaatgtgttgatctgcattatggtgggctttgtgctgtttctaaaatttctagaacagaaaggtttccttgggggactgtcttgtttcaggaggcctgttttgtttaactttttgagcagatgtgtcattattctttattagaaagccctcttttatgctctaatcttgtaaagtacagagatctcggagctagcattggataactatctaataatgaccttctgagtaattgatgatgtcatagctcctccccaggctggagacacgacttaggcctatctgaggtgtccgctggatggttttacaagctgctgattgatttgaaaccctaagaccatttagttgacactgagctgatctggctgctttggccagagtttgggtttagatgaatttggagtctctaccctgccaactgtcaacctctggagcccatccgggaaccacgtaggaggtgtagactatgaagaactgtctgagggtgaactgactataaatgggagaagataatcttaagacagttgagcacacaagctccagagactgagaggatccctcctaaggttacgaccctccctatcttgagctcagagacccagcccctcagttgtctgtgctgttgcctcatgagctttgaaggtgattttgtagttcacatgagcagatgaaacattagtgaaattactggatgtcttagttaggtgtttatttctatgaagagacagcatgaccacagcaactcttataaagaaaacatttaactggggaggctcgcttacagtttcagaggttcagtccattttatcatcatgacggagaacacggtggcgtgcaggcagggatggtgctggagctgagagtgctacattttgtagacaacaggaggtcgactgacagacacactgagggaagtttgagcaaaagaggccttaaagtctgccccaacagtgacatacttcctccaacaaggccacacctcctactagtgccaatccctttgggggccattttcgttcaaaacatcacatgagggatgtctacacagcattcagctttaataatgacacaggaggccctagaacagccttgaagaaagccaaagccacacgacttcatattattacttcttatcatttgttttctgtggagatgtatttgccctcttagaaaggtgtgtgtgtgtgtgtgtgtgtgtgtgtgtgtgtgtgtgtgtgtgtgtgtgtgcgctcgcgcacgtgtgtgtgtgtgtatgcttttttttcacatgcttgcatgtgtatacggtttttaatttgagttaacagggtattgataaatgtcccttatggcaaaaggtttatgacaaacttcctgcaggtgattgatgtatgttctagttgatggctttcatccagcatggaagcccagaagcaataagagtctacaaacccagcagttgtcttgtgtgttttgtcttgggcgaaatctcagaaccgtgtaaggacagaattttcagcttgagtttgcagggctagagacaaaggtctgggctcaaacaaagagagacacaaacaggacttgtcagtaagggaggaacagacagtaaatccgacttctctgcttgtttaccaggtatttaaggtccctcttatgttgattttcccaagattccaaggaatctagagcagtgattctcaacctgtggtctgcagcccctttggggccaaatgaccctttcacaggggtcgcctaaaaccactggaaaaacacagatatttacactacaattcacaacagtagcaaaactgtagttaataagtggcaacaaaatattttatggtttggtgtcaccatcacacgaagaactgtattaaagggtcgcagctttaggaaggttgagaaccactggtctagaaggttgacgaatccagctgccgtttcctggaaacagggtggctctttagtctgatacaggaaatgtggtgacctggtgcagtgtgcagctgcttaaactggctgtggggcactcccaccactcggggtgagtcaaggagatcagttcacggtcatctttgtctaattaggaggtttgggccaacctgggatacacgaaatcctgtgtaaaacaaacagaagactatcaatcaaacatattccttgtatttcctgaagcccaaggaaaaggaaggtgtccagggcacaccttttgttacttcgtcagagggatggagagacaaggaaatgtggggaaggaatttgggtctgggtttagaacccagaagcaagctatctgcccgctgtgcggcacacagcctcatgagtctattgtggatcctggaccaagccctcaagtagccttacacatctttgagggaagcaggaattcctcaagattccacaatgggccacagtgatgttacttgcaaggccaggtgtatttatctgcagattttactcattctgtaatctgccagacattgtcctaggtagctggcattgcccttaacgatggagacaaagtgtctcatggcccacaggagttatctttcagttatctgaaatgtgtgtgcaggggtggtggtgaggggacattaattctgagtgtcaactaaactgaaattggattgactgacaaaacctgaaagatgggccattactgttcccccatatggcctgtaggagtgtggggcgggaaatggacatttgccgtcagaattagggataagactggctggtcagtggtgttcctcattgtgtggctccttcaagaggaggctttggacacggcggtgagcgggaggcgtggcctgctgggccaatctgtggagggtcagctcctgaaagtggtgggatggaacgaggagaaggtttccaatagatggtcttagttctcagctgtgggtgcctcatggctctacgtgttaggatctggaaagttctgtttttaaaagccagaagcaaaaaaataaaaataaaaaaaaataaataaaaaagctggaagcctcctgcttagattttagatgctggattactaatgccagtgcattctctctgtcttcctccctccctctccccgcctgtcgagtgcacacacacacacacacacacacacacgcacgcacgcacgcacgcacgcacgcacgcacgcactcacgcacgcgcgcacacacacacactcttttttaaggaaaagagaaaaagaactgtgatgaactgttttgagcagcactctctcttccgggaagactgttcctgctctgtttctgagctcctggcttatagtctgaatatgtagtgtgtgattgcagtccctttaaccctgtgagatcagctagctttgaatgctcacctagaagaaataagtttaggtcgtgtagttgacggtaccatattagtcctttgtgacagttgtcaaaatgtcatttggatttgtgctgtaagcatggcgccgccccccaacctgcccaggcctactcagctctggggttttacgtaactaattctcctacactgtagttttccagtattttgtcattagaataagttcagggctttgtggatttgatcactgacctgggtttaatgttgtgtaggatataatgaacaccatcaatttctgatcctagggatgtaaaaccttgaaacatctttttaaagcctgttaataataataataataataataataataataataataataatacaaactgcccttacacactgcataagtttgcatatttctgaatctttatccctgccttggaattatccagatattctgtgggttgatgtttttgttcagcttgcttacactgacttattttcagaaattaaaaaggattgtttattgaattctccagtgttcccgccttttgttgactcctggcatctttaaattaaagtaattattcttcataatttcttcagagagctgagcatttttttgtctcttcccttgggttgaaccaaagagcataattatcgtaatgccgtggccagtgttactttccttttaatggtgctaggattcaaacccaggaccatgtacgttccaggcaagggctctgccaatgggctatatccccagcccaaggctgctattttaaaagcaagatggctttctcctgaggtcgttgtctgccaggctttgctgcttgtttttgctgttttctttaatgttggcagactccgcgtgaggagctctgctagccttgagacttgctctcaggttaagatcttgatattggttcatcagagctgttcttcctggtgaaatggccttatgaaaatacgggccccacttctgtgattcgaagagggagtctagtgttttgttttgtttttgttttttgagatagggtaccaagtagcccaggcttgcctcaatctcgtgattttgcactcagattcccctgtttctagtgcgctgagattataggaggcccagtttagaaaaaacaaacaaacaaaaaaaaacatttggttacaattctagaatttgaaacctttgcttctcaccggtgaatcctttttgataggaactggaaattctccggctggagtctagctgagtatcctacggagctggttacctgtgggctgcaccaacctccccaacaaggcagggttagcactagtctcttcttagactcttgtctggccgacagtgtctcacttgtcccccttctgtacctggggtggaggctgtgctgccctcagctccccctcgagccatggtgacagctgacagaccagctcccatccgcctttctaaaccctaaaggcttccagtgtccgtctctcccatcattggtgaccccagttgttctgagtcggagacggatgctggagagggagagggaggttaaatgtggggcacagttgcctctccagtgggagaagtgtctgtgactcaagtctgctggggcaagcagtaactctcaatgacctcaacctgcccacacttttttatacggtgagaggtcgcagagggttgagcctgctcatgtctcggaaacaaagggggcatgaagtagggagaggatttggggagatggtgttcccgaaacccatgactccaaaggccagttctcggaggcacagacacaagagagccttctgggtagtgatgatactggggtggtgtttacaggggttttcatgcttggcaatggcagacgagtttcagaccaggagagcagggacagtatttaccaggaaggacctgaagaagaaacgccaagctgatgacaggtgccagcttcagatggaccgcacccttctgtggctcagagcccttcgctggcttcctttgactaacagggaaagcatttgctttaactcctcaagttgagttaattttttaattgctcctgagcttgggacaaacaaaacacaatgtcaattttcctcatgcacctctgttgctttttcctgagcttagatggcagcccccactaaacaagggagccccacactaccaacatgcaggaggttagagtgtttttgatgcaacttgaacttgacattgatcccaggtgcggttctgtgcaggctgtaaacagttcttaccactttccgtgcatattccagatgctcttcccgtggtacctctgatttctctggaaactctgccccaccgcctataaggcacccctcatactcagctagctagtgttcatcttgaagacctcagcttaaacttgggctcctctagtcacgctgcctgaggctgaggctgctcttttcctctccttggattgcaagtcttactcggttcacacctctgatttctcatttcagggttcctgaggtggctgcaggatcttttatttctctcagaggagctcacagtaggctagtgtaggcacatagtgagacttacaaacgttttatgggaaaacattgctaataggtactttttatatggcaattccaatagctgatatttaaagtgtgtacatgtcctggatttctttctgaatgtgatgtagcagatagtggttattgaaattacttattttcggtgtctcagaattgtccataagtcttacgagtgcagtaatttgaaatattattttttaatttaatttctattttttctttcttcattttcctgcacacacttgatctgctccaagtttgactcttacggatgtcatggtaaccgggcacagcatcctggggttaagttggccttttcttccctgacatgtatctcaatgccgtgatgtgcttgctcctttgttcatcatttccttacatcttgtctttggtgatagaattatgactggtgtgcccttgattttaactgtttcccctcctgaaaatataaacccatggtatgtctgcagcacacatagatttgtaaactagcaatatgtccaacagccctttatttttaattttcactaattaatgctcagcaatgctactcatctatttatcgtgtaacttggtttttatgaggttatggtagtgtgcatgtttccctcaagctgagaaaattttgatgcaccaatcaaagctcaaacaacaattttaaataaaaccacttggccatcactaagccacgctgagggttggactttctagaagtctagttgcctttatgtcagccatgcttctgtaaggaaccctaataaactcattggttcgccaaaaaataaaataaaataaaatcactacaaattttatttttattgtaagagtggtaagttattacaaacatataacacatatgttctcttcaggaatccaacctcttgagtccggtgcaggatggcgtgaagacgccgcaaattgacagcaacaaaggcaacaactaccggatcgtcaaggaggtcagcagccggggtgcggtctctctgcgtgtgcacacaggggttgtttttgttcaggtgcatgttacatggctgtgtctaatgcagcacttcatctcgttaaagatcttgatcaggctgagtaagctctgcgtgcagaacaagaagtgtcgcaaccaacaccagcgactgctgaagaacatgggggctcacgcggtggtgctggaccttctgcagatcccctacgaaaaggtttgccctgtcccgccttccttcagatctgtgttactgaaaatgtatcaacaagtttaaagaatttttctctccttaattgtttaagaggacaacccctaccccagtgtccttggattcttttctgtgtttcccacacacaagggtgtgcttttgtgaaacctgcttccaccttgtaaattaggaagaagcacgatacaccatcacctaatccaacacagcgcgcaggtttcttccatagttccagccatgtccggttgagaaaagcatctgctttaggagcacgctaactccgggcttggttgttctgtctgctctctctcagtcctgatctctcttgtagactgacagttattctggagagcgtccctcacttcctcctttgctcaggttccatttatcttcggtgggaacatggaaggattctagtttctgtgccgagcttcctagcaggcacatgaggctctgatttgttcccacacgagtgatggatgcgtctgctggtttgtccactgtaaggacctccctctccctttgtaataactaactattctttcctgaggttccattgagaataccccgtccttcatccagcctttaattcacattttttgctagcatgggcatgggtgggtaattggaaagtctggaggaaagatggagagggtgggaggaacggagcagacaggcaggaagaataaagagaaggagagaacggtctagaaaggaagggacagagccacagagggcgtggagaaaggagagcatgaacagagccaggaggcggcatgcttggtggagggaggtggttttgtgtaagcctgtcctccgttctcggtgtcacgtgctgccctttcgcctgcagaacgatgagaagatgaacgaggtgatggaattagcccacgccttcctgcagaacttctgccgggggaacccacagaatcaagttctccttcacaaacatctcaacctgttcctgactcctggagtaagtaccgtggcggcccctaacacttacggcaggcagagcgcgtacagcatttactgctctgtgaaaaactttgttgacctttgcacatcgttcttccctggagattcactccataaacttgagtgtttccgtagaagaaactcttaattagaaaatttagacaaatttcatctgcaaacggtggtttcatttacgacatgcgattcaatgttagaataaggattttagaaagcttagtgcttttttcatgataccatgatgaagctaaatatggaagctggggttgtagctcagtaatggacagcttgtctagcgtgttcaggacctagcaccacaaaacccgaaccgaaaacaaactcacaggagctagatgctgaatattccaaggttgcgttgactatgaccagctgaaagcctgggggcagatcttggggctgaagaagagcatttctgtggaaacgtgaggacctgggttcagatccccagtgcccacatagaagccagacacggcctcgtgtgcccgtaatatcggtgtggacggcagagacaggagaactggaggagcctgctggccggtcagtgtaattgggataggtctcaggttcagtgagagactctgcctcaagggaataagaaggacagtgacagaggagtgcgccgatcctgctgtggtctctgcatgtgcatgtccatacatgtacagcacgtgtacctgtgagcacatatacgtgtgcacacagcacacatgcttataccatactctcacaaaaggataaaaaactagcagatctttagagccaagttggaataacgaataagctgccctcaagtcgctgacagtgcacttgctaatttcctctctccagctgagtcccattgtgaggcagatgtctgtctgtccttcagtggttcatgactcatggtgtctcacccaggacaggcactggccactcatggtggcttcacttaggacaccaggcccatggcagtcagggaacataggccctgtagaaccctggccccgcccagtcacgcaggtgcgccctctctgctcagctcctggaagcagaaaccatgcgacacatcttcatgaacaactatcacctgtgcaacgagatcagcgagagggtcgtccagcactttgtgcactgtattgagacgcacggccgccacgtggagtacctgcggttcctgcagacgatcgtgaaagcagatggcaaatacgtgaagaaatgccaggacatggtaatgaccgaggtaggtttgtgcctggacccgcgtcgccagcttgtagcgggaaagacctccggagccatctgggtttactgtgactgctgaggcacccacaggtttacactggtgcagtgcagtgactcagggccatctgacctcacggtcttattaagagtttttctttttgatctgtaacggaattggatccgttacataatgggtcatttttaaatttgaaaaatcgtgtgtgtgtgtgtgtgtgtgtgtgtgtgtgtgtgtgtgtctgtgtgcgtgcgtgtgtgtgtgtgtgtgtgtgtgtgtgtgtatgcctacacatgtaggcaatcatagctattaatttcctatttaagttttcttgtatcccatatattttgagatattatcttttattttcttttgtttctgggaattattttattagttgcatcaatgacaaattcatcatttaatagtatgtcatacaatatctattaagtttcatcggatatctgttaagtccctttgatcaatggtatcattgaattcagctgttaaattactctttttatttttgtttaaatgacctatcagttagtgagggtgaagtgttgatctcacacaatattcttgtgttgggataattgagtttgtttcatacaattagatgcacatatattcagagaatatgtgtttataattataacataatgataattgattgctcacttaatgagtataaaatgaccttctttattctttcccattaattttatcataagtctgttttgtcggatgtgggaacatcagcacgtgtttgtctcctaggttgatttgctagagaagtattttccattcttcacccgagtttagtagttgtgttttatcaagaggtgtatttcttggaggcaacaaattcatggttcctgatttttatacactttattactctgttaaaaattgtgtgtgtatgcatatgtgtctgtatgtgtgtatgtgtgcatgtctctaatgtgtgcatgtgagcatgtgtgcatgcctttgtgtgcatgcctctatgtgcatgtaagcatgtgtgcatgcctctgtgtgcatgtaagcatgtgtgtgttgtgcatgtctctaatgtgtgcatgtgaggatgtgtgcatgtcttgtgtgcatgcctctgtgtgcatgtaagcatgtgtgcatgtctctgtgtgcatgcctctgtgtgaatgtaatcatgtaagcatgtgtgcatgtctctgtgtgcatgtgtgcatgtcactaatgtgtgcatgtaagcatgtgcatgtatgcatgcgtgcatgtaagcgtgtctgcatgtctctgtgtgcatgtctctgtgtgcatgtaagcatgtgttcatgtctctgtgtgcctgtgtgcatgtctgtttgtgcaccatgtgtatgtatgtgcctgtggagaccagtagagggagttagatcccctggagatggagcaacacctatttataacctgcttgatatgggtgctgggacttgagcctgggttttctgcaagagccacaagtgctcttaaccattgagccacctctccagctcctacaatgggtgaaatcttaggagatcacaaggttatttggaattaacacaatttttctatttaaaaattcctctttctgaatgataggacaggtactctctgccactgtttgtaatagttttgaggaacagcgcatgagttaataagtgattgacagggctctattagagcagtaggaactgggtattttgaatgaggtaagaacttaggaaagtgagctaactgctttggaaaggttgatgtgggttagctgctcactagggacacaaaggtggccctttggagaactggtgactagatgcaggctggtggcctgtgcatcagagcagctccacccacagctgcaaggaagctgttacccgggggatcgcgttggtctggggaaatttccatcgccacatgcctttcagttagaagtgagagatgtctgatgtctctgtgttgatttcatatgtcacccagaaatcttaaaatgcaatgcagcctaagacgataaacttttacaaatgacctgtaaataaacaatgaaaagcgcactgtgaagcaaatacgtaggcccttcctttggcacctatcaaaggaaatgcttctgtgtataaggaaatcgttgtaatattatgcataagcatatttggatacataaattcctttgcaacaggactgtcaaagtcagccaatcagttaattggctcattgatttaaatgttaccaatttaaatatagtaactaaattgaaatttacatatcatccataacctgaccaaatatttcctatcaggcttagaaaattggtgtcagtaatagataatagcatggtaaataaaatttgctgccatcttgagcgctaaaagcatacaacaaaatatgaggagcattcattcatgtcccaagtgtaccactcaacattcatgtccaagtgtaccccgcttgtcatctcagctgttctactctccgatgccctcccataaaatgaggacatttccaggtattcatacagttgtaagtacttgaagcaatgtgtaagtttgcttacttactaatgcgaatgcttttctatgattcatttcatttttaatgtgtatagaagtgtgtcagtctgtgggtttgtgcacgtgagtgcactgcctgaagaggccagaagagggcgtcagatcctctggtcctctgcaggagcaggggcttctctgtctttccagtccttcactttactactttatagaaaacagactcaggaactcagacgttcgcttccctagtgctggggttacaggtctgcacccccaggactggctcagtgctgtttggttcttatcccatctgctggtctcatatccccggcccagttttggcagcatcagtcaccagtcacttggcatttgacctttctctcctcctacccgaggaagctctgcttttgcagtgtgtgtgtgtgtgtgtgtgtgtgtgtgtgtgtgtgtgtgtgtgtgtgcgcgtgcttgtttgtgtttgtatgtgtgtgtgtgtgtgtgtgtgtgtgtgtccgcgtgcttgtttctgtttgtaaacagatctgtgtgtcgtcaggtaggtcgaaactcttagaaatgtcgaaatctgctatgcggcctcttttcttcacttcagttgatcaacgggggtgaagatgtgctgatattttacaacgacagagcatcatttcccatcctcctcaacatgatgtgctcagagagagcccgcggggatgagagcggccccctagcctaccacatcacccttgtggagttgctggcagcctgtacggaggggaagaacgtctacaccgaaatcaagtgcaattctctcttgcctctggacgacatcgtgagggtggtgacccatgacgactgtatccctgaggtcagcccgacaaacgcttatcacgtgtagaatgctcctgtctttaaagctcacctgggtgttgggcgtctcccatggtaatagttatgatgacaccacatatttagtagagggattattggtcatgtaattttcaaagtggaaaagagcacaaagactttgagctttgtttgcacagaaggaagacaggccccttgactaacaactacaaatgtctcgtaaggtagtgggttttcagggaaaggttcacttgtagttttgagtgtgaacccggtagctcattggtgagtcagtcattggtgagagagcctaggccggtgctgcagggacccaccatagatccatggctttacctggctgcacagagtatgagtcttctcgagagcatgccacaccctctctcagcctctcttctacctcagctttgacaactggggaaaaatacctggcagagagtgattatcggctgaggaaacccggattgtcagtgaggcttccaggaacacacagtgtaatgatttctttcttttccgctgttatggtatgtcacgacaagttcataaatatgtgctatacactaaaggacataaaatcaaaaggggtcagggaaggtctcagtccctattccggtcaccttgggccatgacaacacagtcaagaacctgaaggagtatttatgtggaaccattagcatctcagtcccagggtccttcctgctttggtggggctgagatggcacagcagagaagggtggagtggaggagaggaccgtgggctcagtctttatccgaggtcctggtctttccatgccagaccccgtgttcagttcctgcttggggtcccgcctttcctgtgttcatttcatgctttacttcttcagagaagagtcctctggctatgcagatacggccacccacatctccaatggagaactggccagttgactttcattaaacctcatgccttcctccaagagggtcggctctaggagggtaatggccatgtatggttcacaattatcatttgggtacctcagtcagagcagatgccagcaaatgtgtctccagcaacttcaacagtgagtcagggtttttatccaatgttctttaactgtgttgttgactcccacagtcaccaacacttccagcatccacagttttaaagtaaaacagtcactgcatctgcttaataggattgagagagattttgttcaattagaggagacatggggacggcccaagggcttcatgcctggtggacaatgagtaggtgcagctgctttggagatgatggtgtctcagctcatcctagcccatggccagtctcaacacggcacacgccattgaggattgttttctagacgccagtggagccgcaggaagcccggtaggcaggaaagctcgtcctttttcctcatggctctgtctcagagtcccggaatcccatggaatgactgacatgatttgtttctatgtacagccttctctcggagacatttgagctcttcctagtgtctcaaggacgctaggtttgctctgagttaagctcttgttttcacagcagtctctgggtgtgggggaatggaatgatggaccacaggcttccctggaccagggtggaatagctgttaaagggaagagagcagggagcctgcacatgtccaaaacaaaccgtgatctgctacaggagcccgcaagacggcatttcatgttgtagaatggaaggcggtgggtgaaaaattgaacttgcttttgcgtttgaaactcacacaggtgaagattgcatatgtgaacttcgtcaatcactgttatgttgacacggaagtggagatgaaagaaatctatacaagtaaccacatttggaagttatttgaaaacttcttggtggatatggcaagggtaagttaaacgctcttcgtggggtaagatcatcggtattgattggtactgattttgattaagcagtaaatgtctagatgaaaaatttgcagttaaaccaactacatttcgatctagtctgttttatccatgaagttgtgaatgagctccaggagatcgcgagcgacattgttactgtaaacagaacacctaacttggcgtgggccgtgacaggtgacagtttacatttataaatgacagcatttgtctgttactaaagggaattgtaggagccttgctacatgggttggaggagacatttggcagaggccattttctagttaaccttttgccgagaaggcaattaaagccacagatggaggaggcctcaagtggttcagggaggaccgtgagcagacttctcatgatccctgttacagtcttccctggctctgataatttggtcatctggacttttcatgaatgttccctagatcacattctgcctttactttgagtctgtttccttttttttttaaaattgggaggtggcatgtggcaataggtatcattttatagatacgtctgccttgagtgttttctctgggaaaatgtgtaagcaacaaggaagggatgctgtttactcttttgtgctgtctcttttgcataacaaatcattattagcaccaggggctttatatatatattttttcaaacaaggcttcattccatagtgcaggtgggcctggagtaactccaggcgagcctcaaactcacagctatcatcctgcctcagccccataagtattgggaatacaggtgtgagccaccataccaggctctctcatttgagttttaagagcgacaagatgtgaagtttgaataaggatttttctaggaaaggcagaatatccacagctccttagacctggtacaaattaaggtgacctgcgcagtcccttaggccgtcctgccccctgcagccctagtagcttatgcaggcctaaacttgttagaggctggggattcccagaatcttacaagtacgattgctaccgtatctggtagttggtggcctcccttgcactctttctggaggaggggagatgaaatccatacgctagagctcccaccgtaaacccgggcagccaagaacaaccctggacgaaaaggtggatcatgtgttcttcctagttagtcaagcatttccagaggaaatgtgttcgttttatttttggtgtggtagagtgatcttcactaggttcaagtacaggcatagttagtcccttcccgttttacatcatctttgtgtgaccagcaagaagtcacttcgtccttcctttctgggctaaatcacagctaggtcttccacacttagctcacaccattaccgttgctgttgccactgacatgaggaaagtgcagctctcaccagctgtgggcagctcccgaggagtccttgaagcgaagggtaaattcaggggctccactggtgcaggaggatgttaaagaccttccaggtggatgggcatgaatcttcggagttccctggtgcctgtgactgagataagctggagagagagagagcaaggtcacactctcagaagttgtcagctgtcacgctaacatggagctaattttcttaaaactaaagagagctagtggtggctgcctgacccagctactcctgcacccacgcaatctttccacttaggaattcagagactgtgcaccttttgttttcctgagtttgcttaagtggctgattatgaagtattgcttattacatgaaggctccactctgggaggcttcctggaattcctgcctgtctgctcaggttgactgctgacgcctttgttcacctcagcttctttttttgtccttcaaagcagagcttctccagggtagacatgaaaccacctggcattttccagaagaggaaacccagggcacagggtcccttcctctctcttcaggaagtttccacattctagtaacaaaacaacccaggtggccttctgcgcagctttccatacagatggctgagccccgctccccagggtctcagactcggcacttgggagataagacgtttgaaacaagtcttatgtggcaccacggttggtcctggggtgacccaagagccactgcagtgggatctggaagggatgtcaaaggaatcagtcagactggggttcagatccaaactctgtctttccctgactgccttacatatactgggaaaggcactgtaaccctggttgccttacaataaatacattttcccaggggccctgggaagagccggtgaggtaacacacaataaattcttagcgcatcctgctctttgcaaaagccttggtggcattatgtcattaccaggattatcacaaggctgtgagaagccttttgggcagtttcaggagcttctccgagtcctaagtgatattgatgacataatgacattgagagaggcaaaaacagactgttcatacaggcgagagccagaccttgtgttcatgcaaccagacaaacattacttgggcttgcatgatgctaaacatgcatgaagccaggcgtgcatatagccagacctgacagatactatgcatgaagctgggcatgaattaagctggaagctgaaaaatgcatgaagccaggtatgcatgtatcaaggcatgcatgaagccaagcatgtatgaagccaggcatgcagggtagtagaatgtgaatgaagccagctacacatgagatcggacgtgaattaagctggaagctgaaattgcatgaaatcaggtatctcagagtttctattgctgcgaagagatgacatgccacagcaactcttttttttaaatattattattattttagaggcactcatatttacatatccatccccccattccctcgccctcccatccaatgttccccaccaacacccaacccaccccccacctcctccccagagatagtgaggtcctccacaggggaccttcaagtctgtcatatcattcggggagggcctagaccctccttcctgtatctgggctgcaatagtatccctccatagggaatgggcttccaacgcccatttgtgctctagggataaacactggctccactgttggaggtcccatagacttggcctcctagctggcacccacattcagagggcttggtttggtccaatgctgtttccccggctttacgactagggtctgcatgctctcactaggtcaggtcagctgtttctgtgggtttctccagccctgtcttggctcctttgctcatcttcctccctctctgcaactggattccaggagtatggttcagtgcttagctgtgggtgcctgcttctgtttcgatcaactattggatgaatgttctaggaatgttaaccaaggtagacatcaatttcatcataggggaagggcatcaaaggcagcctcttcaccactgcctaaattcttagttggggtcatccctgtggatcccctaacatttcccctgtgccagacctctcttcaaacctgtactgtctccctctatcaaggcatctcccttcttgccctcctctattcctcccccatctcagtcctcttgttctcctcccccaccccttctccctttcccacctcctttctctcccccctcctgtgctcccaatttgcttaagggttcttgtccccctccccttcttcaagggactatgcaatcttctcgtggggtcctccttgtttcctagctcctcaggcagtgtggattgtaggctggtgatccttagctctatgtctaaaaatcatatatgaggtggagggaggaggccacagcaactcttatacaggaaaacatttaattgggggcagcttacagttcagaaagtcagtccattatcatcgtggcagagagcatggaccacttaggcagacatggtgctggagaaggagccacgagttcttcatccagatcagtaggcagcaggaagagaaagtgacactgggcctggttgagcatctgaaacctcaaagcccacccctcagtgacacacttcctccaacaaggctgcaccaaccccatcaaggccacacctcctaacagtaccattccctacgaccaatggaggcctcattcaaaccaccacaccaggtgtgcaagaagccaggcatgcatggattcaggtctgtgtgaagccgtgtgcagacatcacttgatacaaactgctgtcaaggaaaagcatcagactcaggtgtgaacagcaaactcctaaaaccccggagccattgattgccatcagagagaaggagctggtgaagagttggtgctggaagctgggttgagggcacccaacatggcaggggtgaaagaggagagctcatggctggtgtccagtcttagttttcagcatctatttctaaaatgatgccattcctatgtttagcatgctttggtttttatttctacacaacttaaaatgtaaagattctcacactgactccaagttttctttattatagcttttaccctgattttacctgagcagcaacatggggcagtccagtcaagcaaaggtgtaacatataccacgagtcaccagtcctccttgccaggcctactttgaaactataaagctgtgaaacttagaaaacttctaggtggcctcataattttgctcctggagtccagatgcataattttcagctgacaccctgccccctgcttgttatagcccagaaaggaaggcttccatcccaacccccagctccagcagcttctcaaagttagccttcgtgtctgccagtgttttgcccatgccctatactggtcctcttttgggctgtgtccaatgttctgtttccatatctttggattctccgtagcctgcctgagcctgcacaattgtatttcggtagaaactcggagaagagtttatctaaaaagacaaatgaagtctcaaagctagcagccatgcggcatctgcttccttcccacacttttctgtagtcatcactaccaggtcttggggttctcagaaagccgtctggagtcactactgtttgtgtcttccattttcctcttcatggcctttatccctcataaggggcaagcacccacaggagtggtccagtgggtaaaggagagggcttcagtgggtaaaggagcttgctgccaagtttgagcctgggaacacatgtggtagaaggagactccggcaaagctgtttaataaatgtaaaaatgatttttgaaagacacacagaaaatctttcctgaaaaatagcttttaataagctcgctgtgttatattgtctcatgtggtcatccttctgatgtcccgacagagacggggcccacgagctgtaaaacagcacaccggggcagtgaccaagtcattagacccagaagaagttgttgcttcctttcagaccgttaatggcggcccactttgatctatgttctaatgcagctgaaacctgtgcgtgtggggcagaaatggttttcttcgtcttggtaactgcttgttgttgcagtcaggggactcgggccattatcaggaggccacctagaaggggtgggtgatgattggtgttagtctcagactgtaggtgtaattttttgaagatgtttccgccttggctatccctttggagaccttacggccaccagctgtattctgagtaatgttccgacagaacaaaattagaccaagaaataatataggatgtgtgtccactgagtgtcatatcagtcatcgattaacaagacagaccaggataccgtgttttcagtagattgcttgggccattcgctccctttcctgccaagcagaagtttggagatggggagaatatgtgtctgccataaaactgcttctgcgtggtctttgttagacaggactaagcagatgtgctatgattttgttgatttttttgtttgtttgtttttggtttttcgagacagggtttctctgtgtagctttggagcctatcctggcactcgctctgtagaccaggctggcctcgaactcacagagatctgcctgcctctgcctcccaagtgttgggattaaaggtgtgggtcaccaaccaatgtccggcaattttgtaaaaagttgaatggacattaataagattcacttgaaagtgttctttttatgtggcccaagaagctatcgtggcagggactggagacgtgtcttctgtagattttgccctctctgtggcacctttcgctcagcggtaactttgcagacccagttttatgttgtttctcgtccttccccgaatgctttgtgcttcatgtggtcggcagtatccattctagtccatcagttctaaccccctcccccaagtgtgcatctgttcatgtgtgcaggggtgtgtgtaatggctgtgtggagggtagaggtcaacctggggtgtcattcttcagaggttctatccatcttagttttagggacagggtttctcactgagtctatcaccagccagtgaacaagcacctccctgtttctgcctccagcactggtttcatgtgtgtgccaccataccaagctgatttttttctcatttttaagatgtattctgaggcttgaacttagtaaggcaagcttgtaaggtaagcactttactgatcgagctccttaaatcctttatctgtgttcctggagtcacctgtctgtctgtctgtctgtctgtctgtctgtctgtctgtctgtctgtcgatgtgtctttcaccttattggccactcccctgccacttgactgatctctcggtatcttcccacttccagatattgaggtatggcagactcaaaccctggacctggtcccttcactgtctgtaggcacttgcttcctgggatcagcaactctcaaatattgatcccaggttgactgaagcccaagtccttctctgatgtcgagtcttgagtctagatgtttacctgacgtttccatttatctgtgtgccccttctcaagttgtgggcagttccagcgctcccactttgcatccagacagacatcctggcatcatttgcaaatcgtactttgtaccccctgaatctgatccttcaccaaggctgtgggttctaaaatgccattaatttggccagttctgaactcttatgtcatatctgtccacatctggagggagaagaggaggaggagggtgtgtgtgtgtgtgtgtggggggggggttggatcaggtccctgcttccctgagattgtccgagactttccaccttttctgtgccttccttccccatgtcttcctagcctcctgctctccttgcagctggctctctgtcctgttgacagtggtctctgttctgtttctctgggcactttcatgccagcatctctgccttctgagaggcttggcccagaatctgcatgcctgtccttcctctactgtcagatactggtttagttatttttgttttttgtctccatgggcaatatctggcataaagcacttagaagaggatttattttagctcacagctttggaggttcatccattacagttgggagggcttgtggaggaagcagctgtccaccttatgacagataagtcatggaagcagggcaagaaaaaagagaggacaagaaataaccccaggtgacctatgtcctcctgttgggtcctgcttgctactgccaactacaaatagacctttggatggattttttttggatggatattttatattcaaagtttaacatgcctttcatgcccacctcacaacacaagataccctcaatccatccctgagagtttccatggcattaacagttccaatgtcactccagagtccaaactcagagttttctctgaggcccaaggaaggactcttagctgtgagcctgtgtggaatcaatgttgcatacttccacagtgaaatagagcatatacttccattccataaggttgggataggagcagcaaggaaggagcctaccaaagcaagactgagacacagcagggcaagcattgaattctgtagctgtgtatctggttcagggcaagcggtagtgtgctgtggattcccagggtggggaggccccacccatatagctttgccattttagcccatgtgcctgtgacctgctcagcagatgctcctggtattgctaatgtccttgggtgtctagagaggcttaggtttcatcctcagctccacacattgccatttcaggacccgcctgtagagaccctccctttattcccagtgtagcctgccttcccaggctttctttgaaatctgggtggaaggccctcagctctgtaacttttatattcttcatgctcacaaaattggcaccatatgtttgtggtcaggacctgacaccagattgagcaatagctgggggaatgtggattgtgagtacagtggcctcctagtgcctggatgtctgggtgtggtaaaagctttgttgatctgtactgcagggcccgggtatctaggcttagctgtgctgatcagtacggcagggttggggtttggtgggtttgagttgcttatgcataacagaacacatgactgggatggctacatgaaaaatgtccagtcctgtaaacaatgtgtgttagttgacacaaacctagacatatctatatatctagggactcttaattgagcaaatgcctccaggagagcagcctgtaggcgtgtctctggggcattctctgattagtgattgatggaggagggcccagttcaccgtgattggtgtcacctgtggcctggtagtcctgagctgtataagaaagcaggctgagcaagccatggagagaaggccagtaagcagcagcacatccctccatggcctctgcttcagttcctgcctccaggtccctgctttgagttccaccctgacctctgttagtaatggactgtgatctacaatgtgaaataagccctgtcctccccaagttgcttttggtcgtggtctttatcacagagatggaaagcaaaccaaggagcagtgcaagatacatgaaataaagtaattttaggtattattaaattgacagaaataattataacctgcaggtatagtagttaattccagtgagaaacacaagactcattctagaggtgtgggtgggtcaaaaggtgtgagaagggctaggtgagcactcgggaggctaggtgagcactcgggaggctaggtcagatatggctgtgaagcagagacttcctggagcaggtgactcattcactgacatctgggcactgaggttaaaagccccacccactttctgtcttttctctgcttcctgattggtcaaggtgtgtcaagcccaggctgcacaggtctgcccatctgctgtcacctctcatacataaaaaggtcatttgttgtgatgtcattttgagccacttccaacctttgctcttattaaagaggcaataacagtaaattttaagactggataaagaacacactattagttttttttctgttttattttgtttcctggtaagtttttcacggttgtaacaataaaagagtcttcctccatttagtgactaccctcagtaggaccagtgtaggatgtaaagtgaggatgctttcattcaagcttggataggaataggtccccgtggtttgggaaacaggcttttcattacccaggatttgagtacagcctcatctaggtaacttccgttactctactcactggtgttttgccagtgtctagttccaagcagtgcagcacgatgtacagtaagtccagtgtgagattccatcccccactgcatgggcaaaggtcctgcaggctgatggtggagcgcgagcgctggtctgccacctgctcaacaaaagggcagttttagccatgaggaatattcagtgtttggaagaggcagaaagaagtaaaatcctaagtgatgcttgtcctggacaaatcagcttgataggagttctgggaccatgtttgattttaatccccagtgtaatgcacaaatacagccaaacctaaagttaagtagacggaagtaagagtcatatatgggacttacttacctcagagacttcctcagtggtcatctctcatacagagtttctcgtcatgtcgtcacttgtcggaagctcaaaaataagagatggagattccagaaatgttagtgacgtcacagctctgtgtcacctctccacagtcactgcagtggctgtgtctaggtgatcctcgatttactcaatcagagacccaaatagagtggtggtgatggaagctcatgtgtgccaaagatctgtgtggtgcttcttgtaagtgaaaagatgaatggaatgagagagagagagagagagagagagagagagagagagagagagagagagagaagaaagataggagagaagaaaacattcacttacattcactcatattgtaatataattttaaaatttatgttattaatctatttctgggccacatttgtgaattaaattttgtcatatatatatatatacatatatacagatatatatgtatatatatatgataaaaacatttataggatttggtacttgttctgcagtcacgggctatagcccctgtggataggggttggactgctgtgaacatcttcttcatgcagtagctgttgcttgctgggacaatgtcaaaattccataattagacataatttatttcctttaactaaatcatacagttctccccaatggtctgacaatgttagttacatggaaacccttttttgttctgtcaacattatatcagtgtgtgtcatttatggaggaagagatggaaagggagttaggacataaacaaacccttccttccttccacacttaacagcccggttctccaagccagaagggccggaacgcatggtttgagaagagaagttttcccttttatgaatttgtgtgaaaagttgtagagtggcatcagattaaaccacatccacttgttcttttgatgaagcaccttactgaaaagtcaaaaatcacagaaaaatttgtgttgcccaaggacatcaggaaaacatgggtgccatccctggcttctcaccctttgtctgtatttgtttcctttgtctgcctcggtttccagtcttttctcacacccgctgctccccccacctcgtcgttttgcgtccatatttcctgtgttttcaatcataactcttagctttcgcaatttgtcagtctgacatttggaaatacagtttggcgaaagggcccggtttagtcagatgtaacgatcagagcaagggcggcagggtctgtctgccccccagctccagtaccagtcttgccctcagcctgctctgcggaggccgtggttaaaaaagtgtgggaaggagttagatttatttctccatttctaccctgaattagttgcttttcctatttctgtgatcaaacgcctgagaagacacttgggggcggggcttacttcagctcacagtttgaggtacagtctatggaggggacaggaggacagcaggtgacagcagatgggcagacctgtgcagcctgggcttgacacaccttgaccaatcaggaagcagagaaaagacagaaagtgggtggggcttttaacctcagtgcccagatgtcagtgaatgagtcacctgctccaggaagtctctgcttcacagctgcagctgacctgtggctgtgaacacaaaattcataagctttaagtggatagcatggatgtgtagggtaaactttatagatgacggtgtcctggcaacacatggaaatgttgggcatgcctccacgttgttcaaaacagcaccacgtgtttgaacccgtcggcccgtagaggacatcccacatgggaatctcaacgcctcttcacggggcccaggtactacaagggaaaatgtgtgtagacccaggctcaccacgaattcttatcatccattcctttgtactcaggatggctcttaactcttctgcttcctctcagggagtggaaagttttcatcaaaatctagtttgtggaccaagggagaggttggcgtgcaaaaataaagaaaaaagcaagttaacacggcctggaggagtgaaggctgggatgatatcgaggcttggaggggaagctgccacagacagtgggtttggacagaaatccttccatctgaaggagctctgcaagcccagaactctgggaaactcttagaaggttccgctaccaacttataatgcagaggcgtgctttgctttgcttcctctccaggtctgtaataccaccacggacaggaaacacgcagacgtcttcctggagaggtgtgtgacggagtcggtcatgaacatcgtcagcggcttcttcaactcgcccttttcggataacagtgccagcctccaggtagccgcacgcgccgcgccgggaagctgtaacctggctcggatgtcctttctgccactcgggataatcgctgtctcttacatttctccacattgtgcccttctgccctgaccaaactttattttagcggctgttttcacgtgttttatgtgtcttagctttttccattttgcctgttctgagtcactttgaaatttgcgcttgagcaaagaatccagtttacgcatcatttaatcagattgaaagatcacagccccatgtccttccaccgtctctcccactagctgatctcttctccaacattgagagacctcttaaaactaggtcatttcctctttctatacgctacaagatatttcacaactgtatgcagaggccaagtgttgaaataatggctgattgttccgatgggtgggcacccgggccagctgctgcatgttagtaatttatcctaaaggttggcatattatggtttccaagtctttatagatacttaaaagtatttgcacttttatacgttaaatgtccacagataaggagacagccaaacatggtgtatccgtggggtgtcttgttaaaatttgtgtttcaaaaggaaaattaatggctaagaaaagtgattctcagcgtagctcctcagggtcacatgaagcatcatttagttgtgtttgtgtggagaacacaaatgctcagcccggtgtctgtgagttcctacctgcagatcctgccaacccacaatcgacagtatcagaaaatttgtgtggtgaacatgtgcagcttttggtcattagtctctaaataaccttttctttacataacacctacatttcattaagaattgtaagttggcaacacacggttttatttgatgaatttccgaatgtctaaggtttaatgtctcttttggtgtctgttggtgtgagggataacatctggcagacgctgaccttggctttccctccactgaatgtggtagtggacccctgaagggacaggtggacggtagagctcagtggcctgaaggtctagccaaacagggttcaggctcagtgagaaaccctgctcaccaatataaggtggagagtgacagaggaagatagctgaggccagcctctagcctacacacacccacatatacacacatactctctctctctctctctctctctctctctctctctctctctctctctctctctctctctctctcacacacacacacacacacacacacactcacacacaaatatagtgaaaacacaagtgaccaattttctgtagtgcttggcgtgtttcctctcatgctattaacacacaagacagtttgtggagtcaggtgtttatgggtggcattgaagcacacaacactgttggtactttattttttggggtcctgtctgataaggtgtagctctgctccctcctcaggcatggtgtgacttagggatggcggcacagtgacatagggtgaccagtgcccttctgtttcagacacaccagccggtcttcatccagctgctgcagtctgcattcagaatctacaactgtacctggcccagcccagcccagaaggcctcggtggagtcctgcatcagggcgctggctgaagtgggtgagtggggtctgcgctgactcagatacacatttcctggagtaactggggttggggctgagagccgttcaagcagcttcccaatctagacctcacgaagaagtaaagccaggccatttgttgtttgttgtttaagttggaggccgacgttcagcaactggttctcaacatggcagttttgggagaaaagtatattcctgtttccaaatttcaaagtagtgttctacttcaaatatggcttagtaggattttgtaagagtggtttaactggttatcttactttaaattgtggaaccaattaaatttatttaataataaataattaataataaataatatgccaatttattaataagagcctgatgttgttaataactttttgtggcaacaggcgttttagaggttttttttagcattgtaatttgtgtgaaatctgaatcattcaaaggcctgttatacactgaaggcttcgacattatacatgaatggagacaagggatttaaactaaggggaagtgagcctaaaaactctcatagattctccccctgtgcaaagtcatgccttacgtagttttgtattattatataattttgtgcataataggtgtgtgtgtgtgtgtgtgtgtgtgtgtgtgtgtgcgcatgtgcaggcacatgcatgtatggctcacatgttgaggtcagaggtcagcctcaaagctattccttgccttcaacctaacttaggacaaggtttccttgttgctttcccctgcatgctggctcatggattttcctttctctacctcccagtactgctgggatccacctcactgcaggggtgctggcatccacctcactgcaggggtgctggcatccaccccacagcaggggtgcggagttacagatgtgagccactgcacctggctgtatgtggataatggagactcaaattcaggttctcaagcttacaccataagcactgagccatcttcctagccgtgtagattaattatggatgaagtggaggaaagagaagaaatataggcttggatgggtagaaaataatagtgataaaaaggaaactagaaaggcatctggcgattgctggtgatcccatgttttcattgtcatggtcatggtcatggtcttggccactgttaatgtttactgagcatttaccatgaccaaagacaagggcttttacaccttaacctttgataggttctttggttatttatatttcaggattcaggaaacaatgatcttggtcgggagtttagtatatgatttaatagtatgtgctggacagtcaatgattcagctaattatgagcattaaaatatttttagtcttcacctagtctgcaatctggcctaagagattttatagtaacaaaacttaatggtggaaaaaaaaacttaatggtggcagcaattttacagaaatgaaaaatcagatataatctaggagtatcagttggtgactactgcatttaatagtaatgtagtttgcctagggaattgattttaaataagaattctacttataaatacatggaataagtaattataaataaaatctctactgtgctgtttctttggcacacatgccccttgggcctgggcatccctctgaggttctgccttggattgcagagcatcgaagctctcttcctttcctcccttccctcctggtgtcctgagattttcttcctccatttgtgtacaagctccagggtcttttattcctctcctatttcttaagtcaatgctgaagcatttagcgttgttactggtatggcaagtgatgttttctataccgtgtttatggttttgttttgatctgatcctttggctctatcctatgtcactctgttgtgtgaggaccttcacctgtacccctgagcctggctgaacctggcccccatgacctcctcactctcaagctctgattgtcctgtgcatcagccctcctgtccagacttggagctcctttctgggctccggtgctctggatcgtggccactttccatacagtactcactgtgctccccctgaggtcttcagaaccaagagactctgcaagggaaggaacacacagggagggagagactcggcacacaatgtgtaaaagccataatgatactctaatctttattttaaaagatacacatagcactatgttcagaggtatttatgtaaaatacaactccttgtgctagaatgatcagtgagcctttttatttgttcatgctttgacataatttctgaatctttaataatacattgctttccaagttataataaaacagtaaacttttttcccaaattaggaattatatcaattatatcaattatatcaatcagtaaaatgcatcatcagaggaaaagcaaatagagattatatttctatatttctctgccttctctctcttcctctctcttctgtttcctcttttagcattcagcagatgcagtgggagctgataccctaccaagccctcagagggagggagtgctgcacacagcattgagaaactgcagaccaagtcaggcatgggagcagggtactgtaatcctagccccgtgggagggtgatgcagggggatggcaaattcaaggagacagagagagcccctgttgcagacaagccagctaatgaagggtgagtgagtgagagctggagaacttcatgtgtgctcaccacctaaattcaaacctggaggggttcggtttgtagccagatccgttccttcatggaaggatggcagagctcaaatggtcacccaaaccacaccagcctaatgcatatttatttattttttgtttttttgagacagggtttctctgtggctttggagcctatcctggaactcgctcttacagaccaagctggtcttgaactcacagagatccacctgcctctgcctcccgagtgctgggattaaaggcgtgtgccaccaacacccggcttatttttaagatttcattttgcagtagccaaaactgagtggtttttcagaaaaacttggctcctttttgtttttgtgtattcaaagatcacgtgtgctaagaaatcttaaaacaattctatccaaatcgtcagctgaggaagtgatgcagagtcaagctttggcactgcatctgttttatctccacgaggccgaccttcaccttcctcttctgttgacccctctgtcttacgctctacaacccctgtctgtggtaggacatacctgtgatcccattatttgtgagggagacaggaggatcaggagtttaagtcgagcctacactatatattatgggctacacgaaaccctatctcaaataacaaaaaatatttctgttaaaatttcttcacaaaagccatttctttccttcatctccacgatgggctctcctcactgttcatactccccttgtggtctttatttgattgtagcttaggtcaccacacacataaatatggctcaggagttaagagcgtgttttgcagaggacctgggcactgctcccaccacccacatctggtcactttcaacagtttataaccccagcttcaggagatcacatgtcctcttttggcccccatgggcactgcagtaacacgtacaaactcacacacacacacacacacacacacacacacacagttgttaaaaataaaataaatcctaaaaaagacatccataggaagctgatgtcacacacggtcatacaccataccatcttcatattatcacaccatcacaccacatataatgtcatatcatcatatggcatattatagcattatcacatatcatttcatttatagcatcgtgtcatatcaccccatcatattgtagcataccgttcaataatatataatgtcttcatggtttcacatcatgttatattgtatcattatatataattcaattatatctcatgatttcatatattgtactatttcatattgttgtataatatcacattgcattgctatgtgttacatattgtattgccatctcatacatcacctcatcatattgtattatgtataccgtcatgtcatatatcatcatatatcatatataccgtcatgtcatatatcatcatatagcatatataccatcatgtcatatatcatcatatatcatatataccgtcatgtcatatatcatcatatatcatatataccatcatgtcatatatcatcatatatcatatattatgtcatataatttcattttgtatcattgtatcacatcacaccattgcattgtagcatatcagtcaataatatattatcatatcttcgtattgtaccatcatttaatataatgttattatatatgtcatttaattatagattatatcatatcatggcattatacaactataccattccatattgtcatcatatcatgtgatatcacgtatcacataccgtcatatatatcacctcagtatcatacatcaccatatcatattacatcagcatcgtaagtcaaatcttcatgtcctacagcatcatgtcacatcatgttatataccatcgtgtcatagcagcttatcactatgtcataccatcccatcatatcatccagttatgccatgatgtcttcatgccagcatttttcatcgtcttgtcgatcatgtattttcatacacgcgtgtatcatataatttcatgctaccctatcgccctgtacatcacaatcctattaccgtatcacagtgtgcctttcaatcatagcgtatctcagatcgtattacatctccatatatcagatcacttcatattttcatatcgtagctcttcacacatcactgtgtcccatgtcacatcagccatgctatcgtgtcttcagagtttatgttcagtcatatagtacaatcatgtgcacacaccatcttcacctctcacgctttccttcctgcttctcgtcactgtttgaaatctcttctttctcacttttttgctgttttcctcatttggaatggagactctgtaaacagggactttataataatatatataataatttgtcatcggggcctgcaaacctacttctgataagcaggataataaatgtatttgttactttctcatcactgtgatagaatgcttgataagaacaacttcagacagaaacggcacggtgtgtctttgcctggtgttttacgtgtatggtccattgtagtgggaatggcctggtgacaagtgtgtctctagctgtggccgctggtcaccttgcacgcacagccaggaggcagagagagagagagagagagagagagagagagagagagagagagagaggcgaggatgttggtgcccagcccacttcctgtttattcatttggggatcccacttcctgtttattcatttggggatcccagctgacaggctgtgccaccctgtgcagcgtgggtctgttctttcttaaacatctctggaaacacacccaaatgtgtcttctagtgtttctaagtcctgttaacaatgagacgttaaccatcacaataggcatgtgttgacttatgatggtctatggactatggtgacgtcacctaggctcatatcaaaaggcaacatgacaacaagtttgagacaaaggtcaaattaacctgtgtgccattctaggatctggcatctcttcatcaacagaatgactattcctatgactttcgtgaaggttgggactttggagagcaagggtctggggaaggtggaggcagggcacagaatgggccagctgtttctgtacaacgggaaagcggggagggacacccacagtgtgtcacagttccacagtgtgtcacagctggttgctgggagtctctcatctctcttgggaactgacctgttcctgagctcagtgaacacccctctggttaggtcaggtctcctgagacatcaggcagtctacaagagtgacctcccgtgaggttcagcccccgtggtacccatgtgaagctttgctgccacatacacaatcattctatttctgcttcctttcaaaatgcatagcaacactgaaatctggcacaactcaaacatttaagaatgcacaatacttaggagaatagagaataataaatctgtgaaatatgacaagattgggggagatgatatgtgtataaagcatttgggaatcggtaagcccattcctcataaatgcagatatccattatagtttacgtgtgtggagcacctgtttctcaagtgctctctagtgctattagctaaacctatcatcaaaaacacttcatcatcttccagtcctatgcactcagtgtaagagctgcaagaagaaagcaggggcattcattaagtcatcccttccttccctgggagcggtaagcccttgctgaatatgtggaggaatgtcaaggccgagggatctctagatgcacttggttagatgctgttcctcgatttactcactcctgaaaaacacatggcaggaaggcttccagcaaacgcgtctatgaatgacttctgtatcatttcacttgggaaagaattctgcctatgtgtctcataattggcgtgtgacctgcggagattaacattgggtagttggttggccacactattgactttccacatggaaatcgcatgaaatgccttttacaaatggttttgcctagtgaacaaacttcaagccagccatccttaaaaagaaagcaatgtaaaaaccattaaccctttagaaagtccgaattaaataaatgtctattttaatcccctgggggcattgtagtgggagtttaaggagtttgatgttagctcaggggtggagtgcttgcctcctgtgagcaggtttctgtcctgaacaatgcagaagagaggcccaggaaaccaaatgctgaatcaaaacaaaatcacctccgtgaactccactgtgttacgaaacagttaatttgcaataagttataacatagcaactattttataaacatttttcacatattaatgtaactgattgtttaatgattccttgttatctggaaggtattattgtagctgaagtaaatcccctctactgaacacatttcctaggtctgagtttctagggtgttagaggtagacagaccacgtaaagaaagcagaaaaaagtgtaaggctgggggccttatctgttagaaaattctagagcctttcatggcactcagaacacgcaggtggagagtctgtgacatttgcaacattaaagtgcacgacgcagagacatgtccttttgtgtgatgctaacccaacctcatcctatttgcaaacatctgatgtttgcagtcatctccaacatggaggaataaagttaatgccggtgagtggcccttctttgttatgaaaatggctaccctgggggtgtccttaaccagcagcaaagccagagaatgcctttctccttaacatcgtgtttggattttgtcaatcttagtaaaactattgtcagagttttaatgtgtttttctcttctgttcgtggggaagaaaaccattccatacaattgagccattggtatttccttttctgtgaccagttccatcctgtgatttgagtccaaccattacatattaggaaatgagctctttgtttggtaaccagttttctttaattttcattggaattttttttcttctagcatgaggaatttataattcttctggggctttttagttctgtgtgagtgtttgcacatgtgtgagcaggtgtgtggaggtcagagggtaacttgtctttgagagaggttctccaccagtctggaacttgccaagtaggttaggcaggctgaccagtaagcccaggggtcctcctgtctctgtcccccgtggtggggttatgcgtgtacaccaccatacttgacttgttctgggctacagtactcagacattcatgcttgtcacacattatgctttcctggctaagctattgtcccaacccacttcttttgaggtttaatttcattttcagaatagcttctgtcagtctgagttgtgccttaattctcagagaattctcatattctgatcgtctgcaccttttgggcgttactatgaaaagccttgtgctccctggaagtgagcatggtggcccatgctttaacctctgcactcaggagactggggacatcttattgtgagttcctcctgtctcacagagaggaaaatgaaggaagggggggagatggagggagggagggagagagacacgctttgagatacctacaacacacgtacttacagctttcgtggtgtgcactcatctttgtctttccagatgactagccaggcctttcttgagggaacgtaagacgtatagctttgttcaagtcgaggactaatggggcatccgagtagtagagctgagttccacacaggaagcttatgtctatactcaaccttgtccctatttaaaaactccagtggcctggggaaatagctcagtaagtgaaacacatgcaagaggtcctgagttcaacctctaatgtcgtattaaaaaaaaaaagttgacactggcacgtgcctgtaaacctacttcccgggaggcagagatcagtgtgcccctggggcttactggccagccagcctggcctacttgccaaattccaggctagtgagagaccctacatacaaaaatgagctggagtccgaggaaatagaggcaaagttgtcttctggcctctgcatacacgcgtgtacacacacacacacacgcacgcacgcacgcacgcacgcacgcacgcacgcacgcacgcacgcacgcacgcatgcagatttatcagcgggacttgggtttgctgaagagcgatttatcagcgggacttgggtttgctgaagagcaggtgaggcttctgcccacatcgtcatccggcagctccagctgttctggttctgctgggctgacagccagccgaattttcctaattaatgctaactctttctgctcacctctcctcatgcctgtcagtgtgcatatccaagcattttcttccgtggcacctatcatggagttatgtgtgttttcagagggtttggtctggcagacaccatcagttactccagctaattaaaaatattcacacaacacacaatatttaatgaggtataaatagaaatagtttttttattacatcttagagcccctgaaaagacttgccatgtccaggaaagttttaggatttataagtctaattaggaggttagccatgcaataaaaatacctgttagtaaaggtcgctcgggtttttttagaagtcgtttttctccagacagaggtcccccaaagcaaagtgcatgggaagccacctctcctttcccacgcgttccttagttactcgggcccctgtcctctggtgacatgtccttaacaaggcagtagttctaactcagaggcagaggagggacacttgtttgtaagaactttcatgtgaccctgattacacgccgcaggcatgaagagtgtctgggcatagcaggtccactagctgtttgatgctgttaactgtggggatttagcctgctgtgtatacaccacaggtcccagaatgtttctagcttgatggcatttaactcagtttggatcacggttttgacctgaaaatgatgctttcatagttaacactcgtgtaaacaagataaaacaaatgctttccccaagctcatcattcctttcggaccccctacccccacccctggtgccctttaaacaacctatggacatcttaactcagcattgtctgtttgatttcaaattaatacctctatcattttgacagagcagagaacctatttcagaaggccatgtttgtagagtttgtttatttttagtttaatttgttgttgtcatgaggtactgggaagtgaaccaagagcttcgtgcatgctgggcacgtgtcctaccacagagatgtgttcccaacccttacaatgtttgttcattgttgtgtgaacacttaccttattttaactcaaatgcattctgctcagacgcagagttaatcttcttttatggcttcaaagtcatgatgtaaccataggctacagtttacatctcagcctgggaaagttcctattttacctggaattcatactctgcagtgcacgccaagataggacaccaggtcaacaatagttgtatagattggggagcagaaaaacctgacactttaggatggtggagtttgttctgctatctctccgtgtgccaccatagtggaacagcagctcataggtggatcacgggtggacatacattgccgtgtgcaaccactcacacaggagactagggctcatcactgaataaattcccatgctcgtcatcagaaattattcctccagcgtttccctcatgtcacactatttaaaaaccattttattattgttgttttaaatcgtgtgtatctatgtgtgtcttgcgtgtgggtctgtgcacatgtgtgcagaccacagaggccagaagaagacaacacggctctgagaagtgaactcagatcctctggaaatatgtacacgtgaccacccggccacttctccagccctacctgctgtgttctcaaactgtcctttgactgtggctgccacctgaagcatccggctcatgccgggaccataagtgtgtggcttgagcagaggtgacaactgtttgtagtatgttgtgaggacagtgaagagctctaggactggttgggcagtgaccctgaagcagcaccgtcctgtgttcaggacgttcaaagcaaatgctgctcatgtgggagacagccggtaaagaacagaagtctcagtttggccgtggaggaagattaagagtctataaaaccatgcgttgctcagcagtgtggaggctgcctgtccttcagggcgcctcggtgcggcgtgggtgcgtaagggatgtgcacagacactgcttgcttcaaagggaaattggtcaggggcagcaggagtctgttttaggatctgggcagcagggctctaggtcagggggctgttcccagctgcctgcgttctgaagccttcagctgggacttgtatttcagttggttccaggctctgtgttggcagcagaaatcacttgttttaaagaggtgttcagttgtgctttctggtggggaattttcatcagcagaacagtctggtctagtattttcctcactgtgtgcaggaaagtctggttttgtctctctctctcttttccaggctacccttccccatctcttcctcacccctctttcctcactgggtcctctcttctatcccgcccctcctccctctcctctcacttctctccccctcccctttctctgtcttgctccccttctgtctatagcctctgtctccctattctcccctctttccttccccttcccttatctttcttcaccttccatcttcttttcctcctcccctccccctttcctctgtctgtccctccttctctttcacgttctttcttcctatctttagattgagaacacatcttctggtgcctgtcaccaactctgacagggtctgtgggtgtgtgtttcttgactgaacagctccatgacgtcataaggaagccccatcctgcctctacactccttttctccctgcttcttgttggatgtagtactggcttccatgtctgtgatttgtgttccattttggaatataattaattcttctgcattggaccttataaattgtgatgtgtaaatgtgtaactatttgcaacaaaaatgaggtctatgggactaaacttttttcgatggagggggctctaggctgtacacatcatgagaaatcatcttttgtttgttcctagccctgttctcctactcaagctcagactgagttgccatagtttctgctattcatttgacactgtcttggattcttttctctcttttgttttatataatctgtgcacaggagtttcagagaaaagtttctcaggcatctgttctggaatgttcttattgggggatggcatttgagtttcagttaaattttgtacaggttactgctgtcaaaaccttttgtccgtcggcaggcggtccattccattcttccacgggcaggcggtcactccatctttacacgggcaggtggtccactctacccttccagcatccagccctgcagacaggaattcagcttccagcttgatctttgcaggcatctctcttctctcttagcactcttaggctttttgtgctcacctggctttgaattcatttgttccatcacaagttgccattctcagttgctccatagagacatgtgggttacacttctggagggtcatagtctcacagtcaggtgttggtggcaccaagctctctacacagtcaggtgttggtggcagctccaggaactgactggctctgacctttctgttagctatgctatttgctgacagctgttggcaccattggcttgtagctcgtaacctgtctctcttccacctttacatggtgtttctccctctgtgcccccctttattctctgatatggaacagtcaatgtggactagagcagagcctaattcaggatgacctccatcttgatgacacgtgtaaccaaatcaggccacatttccaggtgctgacaactcagacatcaaggtttgctttggaaaatgtagttcagcttgacaacattccacagtttcaccagaatgtaaagctctgtgcttatttaatctcattcacaaccactgtgtcctttattcagagacttgacgccctgctccagacacaagaaatttctctttaaaaatgtttattttgatttgttatgtgtacagatgtgtatctgcttctctgtatgtgcatcccaggcatgcagtgccttgagtggccataagagggcatcagatccacaggaactggagttacaggcagttgtaaactgcaatgtgggtgctgggaaccaaaccccagccagcaagagcagccagggctcttaatcactgagccatccctccagaccctcattattttcttaattttttataaccaatgtgtcatttactgccttttataactttcattcgtcaggtctgtatcttcctgtattggccctccctatttcacaacctctttatttccccatttattcttttatgttttgtgttctaggtgattcattggcttcctttttccagctcaccacttttgttctcatccttttcatttaatctttgaaaggtttatttttagagtcatgatttaatttccaagatcgtttttccctctctttaagcgtttttaggtgtggtgtctactcaaagtttgtatggacaataattagaattaaatattgcttatttgtccgtggaacatttgttttcagttgaggtcattgttcttggtgctaatggttttatttgtcatccctgggtctttgtgtggtcatgggtaatgactgacacagggggctggcagtttggaaggtctattcctggcctgtaagccttgcagaagtaagaaaggttgacctggaattctatgagaagggctgggcagatgacataggaaccttccctttgtgtgcacgcatctgtgtattgtgtgtacatgtacatgtgtgtgcacatgtgtgtgcatttgtgagacagacagggaacagcagtgagtgttagggggattttcttgctggctggaatctccatgcatttcctcctgtgctgggcctacccccatgtgcctctccacgtactcttcatcttatggtctttgcagtcatgtcaagctctgttctgcttctctgcaagtcttcaccattgacactctacagtcagaatccttctctgcaagtcttcaccgttgacactctacagtcagaatccttctctgcaagtcttcactgttgacactctacagtcacagaaccttctttcttgagaggagtttttatgcttctccaactttttcctctgggtgaaaacagctgcatcagacttttgagtttgctagtcagagggaggaggaccttcttctcccatgattcaggttgcttcttgagtagctcagatgataccagtgtagttcccagtgtagccaaggccactgggtagacctgtaccaagtccaatcgttcatgggtcagtttttctccaatggtgtagttactgctttactctggtaggaatgctgcaacacttccattttcctcttgacaaggagcatagtcattgctcaatattatggctacataaatctgttatgatgcatatgtccgtgggtcttaaggaaaaaagacaggctccatgtaccaccttcccaggaaggttttttaaagataccttttaactttttcactatttctgctgtcaggtgtttgatcatatgtagttttgtgggcacacacacatacacatgtaaacatacaggtacaccctttaatgaagttaacagcttggaaggatttggctgtgtgttttctgtctgagtttttattttctttggcatctaggaaggtaaagatctgtgtgcttgttgaggtgcttttttatatcgatgttgaaatgagtccatctcacacattaatcaccaagaaatcaaaagggattttgaaggtgcagtgatcacacattgctaattggcctgaagaactgaaatagcttcagcagcttttaacctgaaagtatgggagacgatggtgtggcaaagtttaaagagttaggcctttcttgcatttgttctttctttcttaaaaaagaaaattttcttccatgtttgttagtgtgtttggctaatgtttaaaagctttaaccaaattgagagggaaattcttcccatatttttttctattcttttcatttcagccaaaaatcgtggtattgcaatcccagtggatttggatggccaggttaacacactcttcatgaagaaccattcaagtacggtgcagagggcggccatgggctggaggctctcagctcgatctggacctcggttcaaggaagctcttggagggccagcatgggattacagaaacattatcgagaagttacaggtacaatgaggacattaagagacattactcttttctagcttctgtatcattgaaatgtgtcatgtgatacaatatggttgaaaatatccagttcttcctggggcaaagctttcttctgtagctctctgccaccacctcctcgttagcagtttatggacagattgtcctgacttacttcttaatgagttatataacaacatgttctggtggtttctgagtgagtagtggccattgatcgcaagacaattataatgtcagtaataaagttagtaaaaataacctactgtaaaagacacatgtgataaattaggttttaatagtgttgacccagtttatcttcaggtgtgttcccttatatcccttgggccaaaatcagcccgtccttctcttcaccaggtccttgtgtggcccttttgcaagtcttcatccgtagtctggcctgtatgtttaggatcagtgagccaatgacatgtggctttcattttctgggacagccacaacaaaacaccataggcaggattcttcaaatggcagaaatgtattctcttatgtctctggaggtgggagtctccgatcttggtatcagtgtggtttggtttcctctgaaactgccattcccgactgtggagggcctgcttctcctgggtctttcctctgtgcagatgtacacctgtgtccccatttctgtcccttgtgtgaccaccaccctggtggctcatgtgaactcattttgccctcatgctatgttagtaggtcttgtctccaggttaagtcacatgtgactgtattctgaggttagatttgggggtaattagttcttacaggtgggccccatgaatgtggttagttcccttatactgtagcctgaaagtggtgtgtttgtcctttctaccacatggggacactgtgacatggaccctgcatgaaccaagaaataggcataaaaactgctaatttcttattcttggattcctaactcccaagttgtgaaaaccaaactgtcatctgtaagccattcagctcatggcatttgttgtacaccctggcatgatatttggaatccattgtaaatgtgataggaatggggattcctgcagagggggactgtgctcctctcctgctgaggaccagagtccgactcagcacttaaccttgggtggctcccaccaattgcaacttcagctccatgggagacagcacctctggcctccatgggcacctgcacacagatgtgcccacatacagagacagacagacagacagacacaattaaaaacaaaatcttaaacaaataaggcagaaactgcgttggagagaagcagatagttttcgggacgtgttttctggtagatgggtgggtgaattgtggggccatggaaagaggggtcaaggatcacccctagttagatgtgagtttatcctgggctaaggcaggagacagtgggagagaggaagcttgtggggacttagaattggaggtctgttgggggattctaagtttgagatgcctctgctgatgccgaagtagggctgccggccagatagctgggtgtgtgagtctggagaggtgtggaaatatcaaccctgggtgttctagcgtgcacaaagagggagagcccacagagctggatgagcagtctcagcaggagacgtagctggagcaggaaaaggaccatgatccaacagggcttagtgaagggtcaggactccagcggaaaattaagtatggtgtcacagaatccaggggaaggtggccatggaaaggtgtgtcccatgtagagcagttagattggggtggaaaagaggccacccatgtaataggaaggtgatattcatgactcatgcatgctctgtaataatggggctgccatctgaaatgaagggggcagtgtgcatcaaggattgtccttagaacttgctttaaatcccgcagcaaacctagatggtactggtgtcatgatgtcatgtggggcaattctgattctcagagggaaggaggacttcacctcaagtcagagtgtcgcttgtccaatggcggaagttaatagataataaatcagactggtttcaccagagcttggccatctctgataagcgtcacccctttgtatgacgaacatgcccctttacagaatctttgtccttttaactgtcatcaggaggatgattggaggcctggaaaacgaagcatgttgggtctcttaggaacctggcatcgtgtctacccattggctagatctctaggcaaggtttgtagagctgaatagatcttggctttctacttaggacttaacatgtctccctggtcagggctgtgcaatgttctcctcagacaaagtagagtgaccctggccattataagccctcagccttgatgctgagtgagggggctcatctccgtgagagtattttcgcctgattcggaaatagcacccagattcctttttagcaaggatgggatgaaaagaaactgttagacatgtggccaatcagacctatcaataaatataatttgaaatagtattgaatgtccttaaaccatgcacagtaagctcatatctttgagtaacatatcagtgagtgtttctactggacaagatgcttagctctgggtgaccagggacacataggaaatgtttagcggttgctcatatgcacccctggtccactccaagttgtctccttacacagtgtgtgaagtggtttcactgtttctccctcttactcatgtactctcagaagcctgactgttacctaccaatccattaccttgtgaattgatttaaaagaatgtgtaaggctggagacagcccaggggttaagagcttacactgctccccagagaatgtgagtttggatcccaggccactcacaactgcccgagaattcagcttcagggcgtctgacaccctcttctgggtacccacactcatgtctatatacccttcccctcgtatgtacatagtttaaaaaatctttaacacacacacatatacatacacagagacagagagacacagacagagagagacacacagagagaatatgaatgaatgaaaccagattgtgttgagtgtaaacagcaaacatttggtgttgtgggaagccagggttcatctggcacagaacggccgcgtctcctttctggttaatgtccttacgcgagccccatcttgagaggcactcatgtgggtcctctgtgccttgtctcaggatgtcgtcgcatccctggagcagcagttcagccccatgatgcaggccgagttctccgtgctagtcgacgtgctctacagtccggagctgctgttcccggaggggagcgatgccaggataagatgtggcgcctttatgtcaaagtaagtggagccagaccagggacctttctggtggaagagagagggctgcagcagtccagaacacccaccttctgatccttgccagaaaactccctggacagatgacccacacaaagtcacattaattaaaatttagatgggttaaaatgagataccaccccaccccctcagttacagctctaacactccatggctctacgtggctaatatctaccagttctacactagagtcctgctggatagcagaggtctagactgtgagggtgacggtgagggtgagggcgggaactgactaaagaagctgcagtgtatcagttctggttccctctgaaccaggcagagtgcatggccagagtcttagcttgactattgtccctgctaaccccaccctgcccatctctctgaagagccaagagtgtcatttgcaagcatagctagaaacctagaactcagttctgttactagccacgccacaccctggcactgctgtgcccggcacgccaatgaagccacagcaaagtggaatcagtttccctccttcctccagagaccggatgggctcacaggagtgggtggggacagcctcagggaaggacttggactctgctgagtcacatgctgtgggatgagagaatcggtccagtcacctgccaggcagctggtttaggtccacttaaatcctcatctgctcttgtgaaagagaatctgtgttttttagacgttggaatggagacccacggatggaaatcaagtctgtgtcggcagaggctaatataaagacacggcttaggaaaaaataaaaaaaaaaaaaaaacaaagtacctctcgcacagtgaggacaatttctgggacagtgtgcacacactctggtatcccccatgtcagacccacactcaaggctctttagtccaagctccaccccttctttatttatttaccatttttttgacatggcttccagcctcccacctgcgtggtttgtctacattgcctcctggtcagagttgatttcttgcccttcccccgtccaacatcttctaactcaagtgttacaagagatttttgtccggccttctcccacaactgctttagctcccaaataacacacagatgctatattaattataaaattttggccagtgactagagattcttattggctagctctgcctcaattattaacccatttctattcatccgtgtatttccccatggtcttggcttacccgagaaagcctggtacatcctctcttccagggctcacatggcgactccatctgcctacgtttcccagaattctcttcatctcctagtcccccctatacttcctgcctggccaatcagccaatcagtgttttattcatcaaccaataagagaaacatatatacagaagacatccccatcactcaagtgctgtgtctttgttgatgccttctctttcttaccagcatcaggaaattaccacaacagaataaagctttttttttttttttttttttttttttttttttttttttttgccagtacctctgtttacattttagtagctctcgtcatgtcagatggctatgttcagcctgttgtgtgcaggactgtgtcctgaagccccagagattgtttggtgaatggcagcacttacaggggattgggctaggaaatctatttcctgctttcctcattaggactgtgtaactggaagcaaattgtgttatctgtgagaggctcctttctcctcagcaaacagttatgtagcccgattgtggcttgtggagaggatgagcagtgaggaggtcctccaccctgatggctgaggacattagctggtcatcagccagaggaaatggcttctcagtgacatcccgtggcactcactctaaatggagacttataaacccatgctgctcttgccgtgtcacgggaaaccataattccctttggtctgcatcacgctgttcctctaggaagacgtgtctcacagggtcaggggagggtcagtttcttaacaacccagtctatgggaactgagttacatatcctaatcataaacgttccacttgatactgactctcaggatggctccacccacggtactgaaagtcttcgagagccacactgcgtgcttcaacacagtcggggaaggagccgttcctgtgtctgagttacagcaatggtcaagctgtcttgatgctacacttgtcccttctaatcgcagcagccgctcacatctaccaagcaataccgtatcatacatggcgttaccgagagaatgggggaaagcccactaaactgtggtatcacctacatccatgatattccaattaatgtgatacaatgaatagaaaataataaatgacatgatgacgtaaagtatgctttaaatctttttaaactagcaaaggggaacattggtgtttccctgtttcccagagtgtcatagccccccaaagagctcgctgaggccgggcagcactgagatacataaacaccgcagcgaggtctacaagctttagagacctttggcattacgtgtctgatttaccttgtgccttcagcactgtcccccactcccacgcagcataccgtgtacgtttggatgagaaattggtgtcccttttaaggtttcatgttttgctttcaggctgattaatcacacaaagaaactaatggagaaagaagaaaaactgtgcattaaaatcctccagaccttacgggagatgctggagaagaaagacagcttcgtggaagaggtatcccttaactttcagtactcggaagtagacttgtttcctttcttctccattttgcatttgaaataccgtgaaaggattaagtctggatttcaataggccgttgtacaagtgcttcttactggctgtatgataagtgggtgttattcatgttagccacgttattcatgtcctgtgttgaactgagggacacttagatcacagtggatcaaatgtgcgtcttagccagtgctctgcagtctgtcttggatgttcgtgtcatagtctttgggttctggcagactgtttggcttaaagactttctttgtggtcctgggaattaaacccaggtcctctgcgtgtggtgctcgggtgctcagctgaccaccaagctccacacccagatctccaaatgaccttgtgagatgatgagtgattggaatgcagtgtttagattttgcttaaggtgcaacagctggtggagagtgtctgtgcacgttggctcgtgtttttaagtcagaattatgcttatgtcatttttgatagtattgtgtcaagtattgtaagataacactattgctctaaatacggggaatagctggtctctatttttagctgtattaacaggtgcatagttgatattcagagacataccaacttacagattgtcatgcagttattaaaattgacagttctggtgctcattaaatggtagccagccgtgttctaatacccacagtgataggcttaaatataaaatagaaatcttgaaaagtttttctcttctttttgaagggtagctacctacttttatgttaagcaccaaaccaattttctataaaagtaccttgttgtatttgtggagtatttccaaaaaaattgctaatcctctggtattttaaaactgtaaaggtttggtttttgttagtagagacacgtgctttctaatccctgaaagtctagggtgattggatcttgttttcttagcatgtcttttaaaaatgaaatggagtgcaacattggttgtcagcagggagggctttgcttccaaaccctgcatcaacctggtagcatggctctgttgctatagttcttgccacccaagtattggcacctgagttcagctcccagaaccaatgtgaaaagctgggcatggtggcaaacatttgtaattccagagctggggaagcatagggatccctggccagacaacctggcctcctgggttagttctagacaggtgagagaccctgctcaaaacacatggctggaactggtggtgcaacacctacagttgcacgcacacgcacacgcgcgcgcgcacaccccccccacatcctgatagaattgagtatttactaatcaaaatgctttctgctttagtcgcactatttaaaactatatttggacaacaaataattaagataaatgtgaccagtgtaattttagcaatttttttttcacgtaagattgaaggagaccttacacatttgagtataagttatgggcgttttcaggatctgcagtcgttctcctgtggccctcagtgcagtgctgacacttagccgacttcacggatgaactaggtcaccaagcagaacaattaggtcaacatagttttctcgacaagccttccagtttgacagagcagatcaataccgaatgttctaaaagaaggaaggagaaacatggggaccctggtctcagcaggtgagagtgttttagtgtcttccaagctgctggctctgaaattaatcgcctgttctccctaccccatcctcctcacgctactacgtcagcctccctactccctccttccttttcttttgtctagaaaaccccagtagttcacacgcgggcaaacatgcatggactcttttaagccccgccttcgacaccacacatgcatgcacatacttatgtctatagcacacattagaaaaataaagcaatgtagtggctggagagatgctctgtggttaagagccctgactgctctcccagcacacacatgactgctcatgactatctgtaactccaggagatccaatgctcttttctggcctctgagggcaccaggcacacacatggtcacagagacacatatagacaaaacaaccatgcaaacattacagggagggagagagggagagagagagagagagagagagagagagagagatccaccttccttatttggcgctgtgatgaagcactgaccgaaaaacaacctgagtgaagaaagggtttacagcccgtcatggaggagcaccaaggcagaagccagaaactgatgtagagaccatggaggaagtctgcttactgccttgctctctccggcttgcacagctagctacctctcttatatatcctggtctgctgcctttcgatggtgtcagctacagtgggcggggcccttccacatcaattagcaatcaagaaaacgccccacccacaagagcccatgggccaatctggtggagggaattcttcaacttagggttcttccctggtgtgtcaagttgacagcctgggttagccaacacagcaccccagacaagtagagtcagataaacctctaagaaaatattagaggggtgtgtgtgtgtgtgtgtgtgtgtgtgtgtgtgtgtgtgtgtgtgtgtgcgtgtgcgtgcgcaagtatacaaggaaacattgtcagaaggattattgagcagccgagctcttacttatcctgctgattcccacatctcccaagaacaaagtaagacagaaatatgagtgtaagactctttgctttaagccaacttcttctgtgtttgaagttgctgacacattgccccagggagttgtaggggacagtgtgggagattcaagcgtctccagacagcacaggttgccccggagtccactggcttcttaaatacctgatgcttagtgatctttgctggtggatgggagcagagcgactaagcctgtgtgaggtagtgctggggaacatgctgaccagagagactcctccaccactcaggaggggttgcaggggaaaactggttcagtggttgggcaacaggcaggtccttcataattgtcttacttcccggttcactgacaccgcagtgtctaaaaatgtccaaattcaccatcacacacatgtggggtgaaaggttaacatcaggacaaggcaggggtacatgccctctggaggctgttggctgtattcatttcctagtcctgtgtgtcttctagaggcctttgcatgccttgtctcatgggccccatcttagttagggtttcttttgctgtgaagagacaccatgaccacagcaactcttacaaagggaagcatttaactggggctgactgtaattacagtccggggattcagcccattttcaccacagagggtagcatggcagcgtgcagacagacatggtgctggagaaggagcagagttctacatctggatcctcatgaagcaggaagagagagagacactgggccttgcttgctcattttaaactccaaagcccaccctcctgtgacacacctgctccaacaaggccacacctcctaatggcactacctcagctttcagatagtagctcatagagacctttgtcatccaaaccaccacatgcccttcttgtgtcttcaaagccagccactctcccttcttgttctctcccctctctcaagtgccactccttccacacaagactcccgtgttcttggaagacctgtgattacattggaaccacttgaaaaatctgctatgatccctgccccatgctaagatttttaacttaattttatatgtaaagtgccctgcttccaggttctttaactagagagatcacaagccataggcatgtttgggggaagcatttaactggggctgactgtaattacagtccggggattcagcccattttcaccacagagggtagcatggcagcgtgcagacagacatggtgctggagaaggagcagagttctacatctggatcctcatgaagcaggaagagagagagacactgggccttgcttgagcatttgaaactccaaagcccaccctcctgtgacacacctgctccaacaaggccacacctcctaatggcactacctcagctttcagatagtagctcatagagacctttgtcatccaaaccaccacatgcccttcttgtgtcttcaaagccagccactctcccttcttgttctctcccctctctcaagtgccactccttccacacaagactcccgtgttcttggaagacctgtgattacattggaaccacttgaaaaatctgctatgatccctgccccatgctaagatttttaacttaattttatatgtaaagtgccctgcttccaggttctttaactagagagatcacaagccataggcatgtttgggcttggcagttatgtagcccacctcaaatgtgcgtgtgcacacacacacatgtgtagctgggggcgtgcacacctttattttgtgtgttgaagggtttgtaggttcaaatctgaatggagacttccttgagacagtgaagagcaaagacagtccagtagggtgggagggtggggtggagccgaggtagctgtccgcagtgtccagtcaggagatgagatgcccagttcatggagatggtaatgctacctgtgaacccaggtggagtattaaataaaatagcacacacaaagcattaagagaagggctgatagacggtaagcttttcataagagttagttaccattgccttttaaaaaccaacaccgagaaggacgctatggctagcatgccactttggaatgtgctgtagtctgcagtctcatggtttgatttctcagatatgcagagaaatgagacaagaggttctttaatcttgataagaactcacccaagtgtgggagtgtcatgcatttcttcagcagcttgctgaagaaatccttgacgatttcagcccaagttgaatggaggcaagatgaagacagagctgaggggttttgaagattgaatttttacaaacattcaattatgctcagacttccctcgactcctcatgtcgtgggctgagttgttttcagccagagcattagacagatgtaaacagtgtgctgtgtgaggccattgtccacagcctctcgtggcagcatggcattggacaaacagcctaacaactagcagatagctgtgatctttacagaggcccagctggggcagacagcatttacacattggactgggatagcaggcagaagtttctggatttgacagctttttatctcagagtgatttaggagaaaattctgtcagaatttattttctgtaagaaaattctgtaagaaattatattaaagatgcccctccccctctaaaatttgctgtcacttgaggtaataataattgattcttttcttcatcaggaaaaaatcataactaatcttccatttttgattgtgagaagcaccaaaaagatgtcagaataatactaagcaccttagttcctaccccagacgccgagcctggcagtcgtcaccataatcctccatgcaaatgaatttacaacaaactctgctcctaagaatgtgtttgccaggtggtggtggcggcgcacgccttcgatcccagcactcaggaggcagaggcagaggcaggtggatctctgagtttgaggccagcctggtctacagagtgagttccaggacagccagggctacacaaggataccctgtctcaaaacaaacaaacaaacaaacaaacaaacaaacaaaaaaaccaaaaaccaaaaacaggatgcacttgcactcagccacttctgtgcatgtccttggcctgctttgtagcagcaggcagataaaatacattttggcaggaatgcaatggaatgagcccatgacttaaaaacgtcatccctattttgcaaaggtgaataaacacggctgtagtacagctgctcttcagtgcacttctgttcttagtaagtgtctttcagagatgaatagaaagttgttttgcaaggattctagtattttaaactagagcagcagtaactcggcaaacctgaagacctaccattcataaacgtgtgtgtgtgtgtgtgtgtgtgtgtgtgtgtgtgtgtgtgtgtgtgtgtgtagatacacacgtgtgcactgtctgtgtgctattgtttaacttggtgtcagatgtctacaagtatgaaagcgcgaagccgtctttggagattgactttagaaacagaatgggcacagtactccacctcaggagtttgcattttgttttctcatctgggcaaaacgattgttgaatgggctaaaaacactggtagcttttataaatgttttcttttctgtcgctggtctcgccgagtttggccgaattgctgtgctctatacggaaaagactccatgctcttcacaccttggtgttgcttgcttcaaaatccgagatagctgcatccttcctggtcttgagtcttttcatacaactgagtcattagagattacagctggctggagagctggctcagtggttaagagcaccagctgttcttccagaggtcctgagttcaattcccagcaatcccatgtgggtcacaaccatctataatgggatctgatgccctcttctggcctgtaggcatatgtgcagacaaaactcgtaaaaataataaataaaatacacagagattacaggtggaaggtcacaatgggcatcttctctgggctcagaccgaccactgtccattgtctctgtgaggctgctgagatggggctctcattaacaagctaaactgggtaacttcagaaggcaaaggcaaagccaaaactgcgaaaaagttaactgaagaaaaaggacaagataataaaattaaggtattgttgaattatcacagtagtcatttccacctaagtctgacataaactcttctccagaacatgccccatgacgactttagcttcagtttgttctttttgaaaagaaggaggaggaggaggaggaggaggaggaggaggaggaggaagaaaaagaagaagaagaagaaaaattagttgatttgattcaggggctcactatgtagccctggctgtgctggaactccatatgtagactaggctggccttgaattcacagggatatatatgcctgcttctgcctctgccttccaagtgctggcattaaagtgctgccaccacacacagctttgctttataaccactgtggcatttatggtgtcattatttgcccgattttgaaccttgctctaagattccttgagggtgttccctttagcgtgtgtgctgccattttaaagaaactagggacctgttgagagtgggccagacttgacatatgagctgaagcccccacatcacccctgcagagctgagatccacaaagttctgcacccccacccccaccaccccgctcatctccacccagattcacaccctgtttgagagcaggctactgatcttcactgctaagcttccggtgtttagcacttggccatgcacacagccattgctcagcaagggccttgccatcaatagctgtcagccagcaccagccctagctgagaagcgaatgctcgaaacatcacttgaaatcctgctttgcttatctttgtgttcctggaaggggcaggttttgtgggcttcacacacccgcagagtcagaccagctgcccaggcttcagcacagaaggccaggggtgcaagcggggtcacccacagcagtgtgctgttgtagtgtgcacctactgtgtggcctgtgaagcaagaaaagacggagggtgtcagacggatggacgctgtgcccaggagcagtgggagggactggaacaaaggcaggaaggatgtgatgagcagcggtgaggaggaggaggtgcttccattccagcacctgctcccagccttgaggagaggcctggagagaatgtgctagagactcagttcgtgaacagagaagactcagcctggaggctttgagcccagagaaagccccctaccaaaatcagagggcttgaggctgtagaacaaagacactgagtgagatcagctactgtagcagcctgactgctgaccccagacagtgttggaaccctaacagcaggacgtgaggcagtaggtctggtgttgctgtctttcggagaaggaacagagtatctgcagagtgcaccaggcatcccatgttttccatcagatttacccgttgcaggtgccaagtggatggcaacaaaacctggctgtcaccttgttctccagccgttaccaatgtcatatctagaggagctgtgggctaggtaacaggctgtctgaagtcactcagcactctgcaatagctcccagaggccacggagtcctgaactttgttttatgactaagacaagaggtgggaggggaagtgtgaatgcaaatcccagtatctcttgcccctgtctaacatgttacataatggagccaaggattaaatgatgtcagtgaaacaaacagtgctttacatttgattgaatcttttcaagctggagccgcagactcatttttctgcccgtgtttttattgattatcataaggtgttagttcaaatcaagagtggcataaggaatggctgttatggaaggctaaaactggccctagataaagtgattagcctccaaacccacaaaacaccagtctctccacaatacatcttagttaactgatttgaagctgccctgagcagtttatagtacaaagctaatctttgtgtggtgtttttcagcttagtggtattaccacagtccaggtggactcagcattgtggagacccaacatccttttagagacttcagagttcactagctcaagcctgaaatcctatacaggaagctagatgaagcctatttctagaactagttagtattctatatgatcaataatatcacaaaagaaagtttaaatatgtatatatatattaaatatatattaatcttataaattttgagataatatttataccttaagaaaagttttaaaaagtcaaaacaaaactaaagaattatgagattagtggcaatagaatattccctaatttgggtttttctcctgtcccatatcaggtgactcttctgacatgagacagattttggattttactttaacaagcatgcttgggtttagagaaggagagagccatgctccaactccaaagccagctttcatttttaattggcttgggactaggaagagaccatttgcatatatgtcagtagagagcagtagagacaaacctttgggaaggtttatatgagattttatcctattgtaattgtgctatctcattaggccaatttactctttttcttggggaattttttttttctgcatgattgattcatccttcatcttcagatgtcttatctgtcctgtggtctctagattccttagttggatacctttattctcctgcaaagacaaaaacaaaaccctaccacaactttaactttagagtttccccttttgacaggtttaatggccatgatgtttgatgaactgttacctctcataatcaagagggctctcctgtttgcatctagtctttatcagttttgatggtatctacagctcttcctctcctatggaaacaaagccaaaacctgttccccaacgtaacacatatcctggttttgattctgaggtcaatacatctttcaagtatacaggctgatttagttcagtagttttcttctatccagtgtctctctgcaactattgttcctttcttttaccctaaaaaaatttaaagttcacagagtattgtgcaatctaactctgggagtctttattacccctttctgtttcttaagcttgtcttttaaagtgtggtatacctgtaatatgttttatgttgtaatatgcagaaaattatttcattttactagagacatatgctggaacattgtcagtcttaatttatacaggtattcccataatggccataacttctaacaaatgtgtgattatcaaatcagcctctacagaactcaaagcagttgcccactgaaaatactgtgtatgtatctatggtgtgatgcacatactttaactttctaaactctgcaaaatgaaatacatctgtctgtcaaatttaatttctttgaataccctttgtgtttcttcctgcaagtagtgggatttggttgtataaagaacaagtaggacatttccttggcttgttgccaagtgaaagaaaattctttcttcaaactcttactattgacatggtgtttgtcatgaaattctgaggcttctagcacacttcctaccagtagctgataattttcatcattacctcatgcaagagggcctggtagacccatatggtatctgatatgtattatatacaagggataatttatatttttgattatttattgcaattgaataaataggaaagtttattctgaattatatggaataatttcagtggcttcaatatgtaaaacaactctttatgcaaattgagagtcagcaactacattaagaggttctggaaaaactaataataccacaacaatagcatgtaattctgatttatgaactaaatcataagggccttgaggcactttacttagatttcatgacttataacctgcctttccagaaattggtgttccttgcacaatgtgaggaagaatccaattaattcttttattttggggatatttgttactaatctctcccaagaaattactgcaggctctttgccagtgttcattttccatccataatgaggaaatgtcagcattaggaaaaagcactacaatttcttttgtgtcagtttctgttaatttatgacatacatctcaattttcctttcagaatcagtgcagaaaccctttccacatagatctttatttatttatttatttatttatttatttatttactctgtttgtgtggtaaaatacccattctaaaatattatcttcctgtaggaaaatgtgtggaaggatacagtcaaactggattcaagcaaaccacatgtgcatcccatagtttcttttctgccacagccaattctttctaagccttaccttgtaattttcttgaactattgaagtctctatcatcttgtaaagattcaaataaattacttgggttttgagttgttaatccaattgtgggctgtagctagttaatatttcccagcaatttttgtaaatcattaagaatgtgtaattgatgatttgtactttctggggttgaattttttgtaaacctatccaacatcctaattaagtaatagaaactctgtattttttctggagcaatttgtaacctccatcaaggcagaattttccttgcttcttcaaacattttcctcctaaggtatccgtgtctgaatcaactaggtagatatcatccacatgatggtaaattatagattgaggaaacagtttacaaattatttccagtgactgttgtacaaaatatggacacaaggtggtgctgtttaacatcctttgtggaagaactttccactgataccttttaacaggctggggattactgtaagtaggcactgtgaagacaaatttttctctagcctgttcttgtaaaggtatggtaaggaaaaagtcaatcacaaaagtagaccatcctttaggtaatagagaaggtaaaggaatcctgggctgtaaaaagcccattggctaaatcaccttatttatggcttttcctttcttccttccttccttccttccttccttccttccttccttccttccttcctttctttctttctttctttctttctttctttctttctatttctttccttccttctttctttctttccttctttcctcctcctcctcctcctcctcctcctcctcctcctcctcctcctcctcctcctcctcctcctcctcctcctcctcctcctcctcctcctcctcctcctcctcctcctcctcctttttggtttttcgagacagggtttctctgtggctttggaggctgtcctggaactagctcttgtagtccagactggtctcaaactcacatagattcgcctgcctctgcctcccaaatgctgggattaaaggtgtgtgccaccactacctggccttatttatggctcttaaatctgttaacattccccattctccaaatttctctgtaatgacaaatataggagagttcccaggactggtcagttcttcaatatgttgagcatttaactgattctataccagctgttctaatctctgtaattttatgatgtcaaacctgactgttccacccagacagatttgtcaggtaaccattttaaagatagggctgttggtacctttgaaagatcaccatctgttctgccctgctcatgtacaacctcaacagtctctgaccacccttaatacattttaatatttctctcagaagcagtctttattttgtggtttgtttctgagatggggggagtgttaatctgtgttttccattgccgcaacaaatcacagccccataaattcattgctatgttggccatatatggtttggattttcctgtctgtcctggccctatgcattcaatgtatctagcacttttttttttttttttttttttttttacctgagatacgcagcagtccaggaagcccagctcccagggctgcctgcgaggtagcaataggaatgccttcaaggaagtaaggatttggggggaatttcctatctatctatcagggctggaactgaaaagcatcccaagcctaaagatacatgttctcttcctgcatatagtcccgaagcacaaggagggaagcttgtaaatttttaatcaaggctgtgggaccagaccgtcttctgcagccctggctatctgtgaaacttttccccatgtaaagttgttcccctctggacttgattaattggttgttatttttgtcctccatacaaatcttaggactgtaaagcatgaacagttagttagctgagcctaaaattttgtatcacaaactaaggttagaagtttgtgcagaaagctgggtgttggtggtgcacgcctttaatcccagcactcgggaggcagaggcaggtgagtttgaggccagcctggtctacagagtgagtgccaggataggctccaaagctacacagagaaaccctgtctcaaacccctccccccaaaaaaaagaaaaaaaaaagaagtttgtgcagagtgttaattgctatggaacttagtagggaggggcttctggtctctgttatcagccaggcaggatggaaactggaaagtgatccaggtctctctgtgtctcaaagaccttgatttaacaaagcagacatttgcatccctgatccctgagcattatctgtgaaaagtctaactcataatctgtacacagagactctcaatctggctaatctccctatctgcctagctaattgcccagaacaggtttctatgtttctcactgttttgtgggacaaaggcttgttttaattaccagaattacacagtgtggggagaagtcatccttctgtcagtgcagagaaataatggtgccccaaaagtgaggaacatacttccaaggttgtgggacaaatcccatggctattttaggggggatcagggtagtacccaagagaatttcaggcagaatcaatcctgttattcatagacaatggatccataaaccttgtttatgagtttatcctccaccagataaattgtttttctcggcgatcgaccttatgaatatcagctgtcatctactgtgtatctttctggacaccaacagagatacagttccaattctagaggttgaacatgtacctcctgaaaaggccaatctgaatgctgaaagacccccaggcccctaaggggcacagggtcccgaggagcccccgagactcagaaaccagaccaagagctgcaaaagcaagagggtttattgaacgaatgtgcattcaggtgtcagcaatatcgggaaagctgcacaccccagcatggggtgcaagctccttatataggaaagcaccgcagatcagcatacaggcaaggggcacaaagtgattgattacaaagtatgatctcgtgttagagaggtcacccaggtgtgacctgcttttctacaaaggaaaaaccacagaatgtaccctgaaaagtccctgattgtctgttggccagccaggtgtgacccaaagagggttgtcttggcgattgccctcgtctaaaccataggatgtgcccggggttggggccaacttccttgtcctgggccaaggcctgtgggaacctttttctctctgtgaactaaaatctttcaaaacttttctctcagcaaactaaaatctttcaatgccaaggttttgtgaaatcattgttacatcttcacctgtgtctacaaaacccccaatttcgatgtcctttacatgtatttttagctttggtttctgatcatttatagcagtttgccaaaatacttgtttctggtctctcctgaatgttttgttgtatctgtggaggttcttttgtctttggacatatccagggcagtgtttttttttttttaagatttttttatttgaattagaaacaagattattttacctgccaatcccagttcccttcttcctcccgttggcagtgtggttttaaataacaggatctgactcttttaattgctctgcaaatgagtttctccaatggtgacagggaatgattgaaccctatctgatatgttgcctgcgggaggccactcagggcattttctgatggagaattgatgcatttcctgtcccatgttgatcggcatccattagtccagtgctgctctttacctaccttctgcatattgcacaaggctgggcctggtgtctggattatctcttaaaaaaaaaaaacacattgtttctaggagcatcttcctataattccttttcaaattaccttgtctatcataattaaaatgtctgatattttgattttccttaaaatttgtagaaatcccttctcctattaaaacagcatcatagcttatgatgccacatcagctgtctttggatccattcatctctgtgtgctgatcttacctttagaggctggatcaccataatcttgcattctgaattagcattctcaaaagccaaagattcagttagtgtttgcctaacttctggatctgatatcattccatttacagctgaggtcaatctttgtaaaacaaaacaaaaacaaacaaacaaaaacccagtggtggtttcttttaggccttgtgtaattttagtaaatgactcagtcccctttcctgatccttcaaccctgtcccaagcattcaaagctgctgtgtgacacaacaccaaagtgtcatcatcaaatctagactgttttctccctcaacgagaagctgctcttgggaaattgcaaaccctctagctgtattcccctgttctgtggccctagcttcctttctctgccatgtttcccattgtaactgaggaccagcttccaatattgctgtagctaaatgtctccagtcttgtggaatgatactgttcctagtggcccatgaatttaacatctgctttgcaaagggtgaatgcataccatgaatcttaatgcattccttaaatctcttcattccttaaatataacatttctccaggatcccaggtaacttctgcatggccttgatggcagctaccatctggtggtcattctcctatgctaactggataaattaaggttgattttctgataaccttgggccattcctcttcagtttcataatgtaatggtgtggtaggttctgctctaaattcctctgtgtctgagtatttttcttcttttcattagtaagtctgagacatgtcttatcagtaataagtctttctaaagcttgattcttatcaatgaatagtaagtcaaattgtcatatttgcacagtcttcaaaccactttttgaggacaaaatatgaattaccaaactgacaataactatgaatgacattatgtcaatcccacctaagttgttttcccctcatttaatttttcatttgccagccatccatagtagccctaaatagggtcctaactccctgcattgtgacgtttcagattcttcacatggggaagattccatcttgtctctttttaaaaacccaatcccccatttaaaaattcccaagtgtcttatcagctctgacgatgctgacatcataggtggggatgtatggggataattaactgcagtgaccatgctcgactgtgtctgaaggagggcaggtgcactggggaccactgtggctgcttagtgttgtgtggggagtggggtgagctgtctgaggagctcaagcaaggaaataggaaatcagtaggagaaatctgcacagcggggatacagcatgggataggactgcccagcttgctgctacagagaaaaggcaagatgcaaggtgggagaaaaccaagctgcctgctgggagtgtcgggtagggtggctgaccagcagtatactcagctggctgttgctgtgctgggctgaagacacctgcttgtgcaaatgtggggctgagggtgtagacaacagctagctgtggtagaggtcactggcagtgacctcagccgggttcctcagctgcatgtggccatggcagcagcagtaaaagcccaagccctgagtgggtctccaggcagccaaactggcctgggttgatggcccagggaggggattgggggagaaccacatggtgggaagtgaaggcatggggcggtggtgggaggctcatttaggtggtgttttggggcctggtgtggacagcagctgacaactgatgtagaaagactgcaatgcaaaaatcccccagatgggagaaaaaggtgcagagggattgtggggagggaactaagcaggctgctatggtggtggtggtggcaacatggtgggctcaccgccttggcatggcttaataatgccaggtgttggatgccaggcataatgaatatataaattgttccagtctaataaaaacccaggagtcacaaattgagataaagacctggtaaatttgacctctctccatggttttcccaaaccatcagccccagaaattccccctggaaaatccctcttctctcttcctgtcctctctagcagacctcctcattcatctaagaactctatggctaatccctgtcagccaatcgctgactctgtcctgtgatttaaggtggctttgttgtcacagaagaatggctttatgaacaattctgcaacattagagtccatgtcccaatgtgggtacctctcattttgttgagatgtcaggccacagagctgtgggatgctgcatgtggctacagagcaagagtgatttaacagtgtagaacacagaccacatttcatttgtgtctaatggtttttgaacatctgccatgtactgtttccttcagcatccgaattggtattggcatcagtttgtctcctgcttgttccacctggtgcctgagactcttaagcctttctggatacttcttccttcaagcaaaaggcaccaagagtttgaacgtttgcagatttctcagtggagttgtgaggctcatcttttcacagtcattcttaggttttgtttgtgttgttaactacacttcaaactacagactctactgcttacacaacatagcctggggaagacaaaagaagtgtgataggaacacaacacggtggcttggtatgaggagcccagaacatgacgtatctaatgaggaccaggggataatttggattggagagggcactggggctgagggtatcaacacagaggtgtttttctttagtgatctctatccaaagttccgagtctacttcctgtcctcttgccgtgcaagggtgtatgtagtcttcgggatctgttagtcccatagaaagcagtaacctcctactttgccactgtgggattgcttttaacaattcaccatcaggatcacgccatctattaccagcgtgcatatagccattgatgccggagaaacaggctgtgacctgtggagagttggttgtcttgtgggcagatccagactcttaggctcattgtcctgttttttgaatgacagttctgacagtggttccatggtgcttttccctgtcagtgaacagagcaacccccaagacccctgggcagccatatttccccagttctctgcacccctctcccaagttcctcttctctccctctgcaacctgtgcccgttccctgagaggtgcctttccaaggccagcccttttattgaatgggaattttctcccccatcctccacctggaggaaacctgcatgtgtgcaggtttccactgctgccccagggctgattcctctcccatttttgaaattcttaacaacttgatttttgagtgaagaccttggactaaatcatcttgacacctgtcacatccctccattcatcccagacggtcctcatgcatatctagttcaacaggaagttcccacagctaatactctggcctctcagctcctgacctcggcatcatcagggacctttcttctccatcacctacctgtcatttctcgcacctacaggagctattgcatttgtgcagccactcatccaggagtcccagcacccaggtctctgctgtgcctatgctggccatcctcagacctaatcaggacctcagatcccgctaacttctcacctcctcagctcactcatcctggtgtatgtcagccttagagttaatagcacaagccccactgcccagcatctgaggcaggagactccccatcatcattccgaaggaaatcagggggaagggtgaaggtggggagtcataatgagttcaccagaccccagataaatgataaataggtcttttattggggatgaacagtaactgtcgcggctttcctgctcgaaggatgcataccctgtctctcctatgctctccaagacccaaaaggggcttccatccccagctcctctatcttaaatgggtcacatccacacctgaaaccacacccaaagggtgtggccactgttacaggttctcaggcaagatgctaccacagaagggaggcaactcctaaggagttggagagttgttgacaaaacacaagggaagagatgtgagatgggctccaagaacaaaagaacacccgcttcctcccgagagcgacttgagcagatggtatctccagactaagttagctggctgggttttctgctccctccccacacagcccctcataccacctctctctctgaataaacagactttccaaagttctctttcaagatagcgtctgcctctttgcacacgtgggcaccgtgtgatcttgggagtgaagtggctgagggatcctaaggctgagaacatatgggcagcagtattgcttcttctcagagtctgtgcctcctaacaagacatctgctgggcactctcgtcttggatcataagctgttgtttgccaattgttttcataaatattaatctccgagatctcgactgacatacgagttgttctttcggattcttttcttattttcatgtgccatctttacacaattgtgccaaattacagtgaaaagggattttttaaaataaaaaattcctatttctaaaatgggggttacgaaatgtctaaagaaaaaaaatgtgactttttcctttacattgagattttccttctttttaaccaaatgcgttggctatagaataatgctttcgtgtttgtttgtggaagtgggtaattagcttcagtctttgcaaagcaccccagaaaggcattgtgtacttgatggaggtaattgttctgtcttcctctaaaaggaaaagcgaatccatcttagtctggaactgtgaattgtaaagttggatcatggttttggactttgagtagttctgatgttctaatgtgttgtgatttgacaatggaccttccccacaagactgtgtgtttgagagcagtgttctccagcagggggcgccgatgagcaaggtggtggaagcttgaggtggtgcctcagtgacggaagtagctcagtgcagaggggccttgagattttatagtctggccccgcctcttgtctgtggctgcagacaccacgtgaccgatcctgccaccatgccatcgggtcccttttccctcaggttactgcttgtttggtcacagcaacaagaaaggtaactcatatatatgcacatttgattgatacgtaaattccaataatcacaggctcactcagcaagcctgtgatgcaattaacaggccctctgcccgagttgctgttttacagtggtcggcagctctagtgggcgtgtgtggctccccactcccttcacagcccccaggaagattttaactcacatacatggggaggtgtggaagttaggatccaccagacccagtataattggagtggagtttattagcaaacagcttacacggggaacacacacacacacacacacacacacacacacacacacacacacgtgcgcgcgctactgaatcttggttcattttgattatgtgtggcacccctggttcatttaactgtttcctctagaggccggtgctcagagcactttaaatgatcacgtgtgatgctggagtaatggaatcattttaatttcaagactgaacggtgttccacacgggcacttgatttgaaggctgtcagggagtcggtgggtcatgcgacactgacaacaggaaagaccaggtggtgaaatttgggggagctatgtggccctgtcactgtatttgacattctccttaggcagcctcctgccccgccctggactctagttggtttctttttcaaaggcatgtttaagacccgcccctgccacatgcatgtgtgtcacagcttgtgtgtggagatcagaggacagcttctgctgttggtccttccaccttgttagaggtgggggtctctgtggtttgacgtgttcctgcttagcgtctactgctggcttgacacagcctagagttatctgagggagtctcagctggggagtttcttctttcagaccggcctgtgggcattttttttttcttgctatttgatttaggaggaccagcccaccatgggcaggactctccctaggctgagagtcctgaactgcctaagaaagggagctgagcaggagggaacaaaccatagtttctgtttcagttcttgtcctggacttccttccctggtgcactgtgacctggaggtgagagctgaaataaatccctcccctaagttgcttttgttggagttttttttttttttttttttttttttttttttttttttttttgtttgttgttttggtttgtttttgtttttcgagacagggtttctctgtgtagctttggaggctgtcctggcactcgctctggagaccaggctggcctcaaactcacagagatccaccttcttctgcctcccaagtgctgggattaaaggtgagcgccaccaacgccctgcttgttggagtgtttgtcacagcaacaggaaaaacaaaaacaaagaaacaaacaaaaaacaaggtggctgctacaccacatatgctagagactctggccctgtgcttctggggactgtcctgtgtccacctgtcctgtgtccacctgtcctgtgtccaccccattccagcgtgggagcccttgcaattacagacttgtaccgccacacccagctttacacaggttccgaggatccaaacccatgcaccgaaaaccccttcacccactgagccgtcccctcagcctgacatttaagatcttgagaggagatcttcatgagagatttggactttctttcatttcttccgttgttcattcttctagaaaatacagtgtcccacggtccatgatgaaaatgtatttcttcagctccatgtggattcgcatgagccttctgtgtagagaagggccactgtgccctgctgtcttttaaccaagttggggttggggctccctttgctctgaggcccagtagaaagttcctttactcttccttgccttccattttctgggagtcaagcacgatgccttgtttacacatcactttgctggtgtgcaccaggggtgttttctggaaggagaatccccatgtgtctgcagagtgttatctcagggagaaaggtggatatcacacacagcgtaaaccacaccacaatgggctcagatgccccggagatgaatattctattccggagggtgcactgcatggcagctagccagcccacatggctaggaggatggttgggttgactggcgtcctctggctcatcactagctaccacaaggagggtcatgtggacaggtgtcaggtgtttggcgcctgttacatgagggaatgaaactgttagaattcacagcatttgtcatacagagttctgcagaaagagtggcctggttaatggtggagcatgaaaaatgaatgacccagagacagatattgggggtcaagcctcaagctgaagatcagaaaagcaaagcagcagccactagctcttaactctgcctcagttcagaccaaaggggcaatcgtcaaactgctccccagattcactaagactgctatgctctcctcaacgtggctatagaaattcctgagactgactactgaagaccctgttcctatcttttatatctctctagctctgggactaaaggcatgagctctattgctcttttagactgattcaatctcatgaagcccaaggtggccttgaactcagagagatccatctgtctttgtctcctgagttctgggattaaaggtgtatgccaccactgcctgatctctatagcttgaggctgactttgctttctgaatcctcaggcaatcataaacagtatgtccccacacagtaggaatttattttcttatggctccagaaatctaggtgaaggtgatgatgaggtgttttcttctgagggtcatggggaagggatctgccccgggtttctctggtgggcttgtaggtggccctcatgtccccttgtgtcttcaaccatcctgtcttgccgtataggtttatctaaatttcctcagtatgacattagtcattcaggatgataccagccaatgacctagttttaatttaattatccatttaaggatgatttgttcattcagagctaccaagtggggttggggcaccaggacttcaacctgtattgtggatggaatctgctcatcccaatgccatttctttctctgatctgctcatcatcatgggctgtgtgcaaataaatgtttgctgtccgcttcttatgctgaggacagcgcagtagacagccaattggtggcacacactgcagagctagttaggaaggtgtttctaaacagttatttaagcatgttcaaactaacagaggaaacctgacatggtttctgctttcccaaaagagctgattgacaggggggtcccgtgacactgagacacacactttccctccctccctccctccctcctctctctctctctctctctctctctgtgtgtgtgtgtgtgtgtgtgcgcagaaagttgggccatgtactgaaagagctaagtagtatagaaaaaaaaaaaccaatatgggaatttgaaaattgacagaaaatgttcccatggtagtttttagccagcgatgattctgcagtctccccgatttttattgactactttttatgttcgatgttcctgatcatgaagaattgagagtgggtaattgggtagtatctttgatatctcctctttgctacaaattaaatgaagcagttctgcttggctatccttttgacagcctggtcgtttccatagtaaaatatgtatgtaaaaatgctttatccagggccttgatgctagcttctctgtagagtttcacctagggaatatgatgcctggattccatactcactggtgcaaaacaagcaaacaaacaaacagaaatgcccttaattgaaaaccatgtcctgttgggaagcaggctccctacttcctataagttttcataaatcacagatgattctcctgcttgttttggaaaatgcaaatctttaaacagctggtggtcacttctaagactcatataaagcaggcgctaggaaacaaagaagacaacagcagttgtagtgactgctccagcggcgtttcaatgggccattccctatgtccatatacgagagaaaaacggaagaataaattctcaactattctaaagaaaaaagtgactcatgtcagtatttcatgagcatcttggtttatgcttattgtttctcatagcaacattttattttcttgggtctaaaaattttctacatcaattatattttattgagtttactcttgccagtagagagtaggcagtcagaatcagaacagtaaagctggaacctaacctgatatctcagtcttgcaataccagatagctagaaggctgaggcaggaggattataatttcagaatctgcctgagttcaaggtcagcctgggcaagttagtgagaccctgtgtcgaaataaagagtaaaaggtctagggatggagctcagaggtggagagcttgaccaatttgtttcaggacctaagtttaacccgagagcctccacatgatgaatgaatgaatgagtgaatgaatgaatgaatgaatggataaatgagtgaatgaataaaacaaaacttgaaggcatttgcagaataatagcgctatcttccaatagtgcctggtggtttttttatttgttttgttttgtttttgtttttgtttttgtttttctgcagcatgcaacactggtttgttctttacattgcccagttattttggtggacaggctatggcgagacatattaggagaatcctgtgggtgttggcaatagtctgaaatacccagatgcagaagcaggcttgtctggttattaagtagctgtcttttatctcactccttggggcattcaggagagaaataattgactgtaactgatttaattagccgaatgcactttgcattcaccagcaacccaaccctgagaatgctgaccattcagtattaaatgtggctctgacttgaatattgaaagtgcttgactccagacttagctctggattttgtccgtcctcagctcttctctgactgcatcaacagaactccgactaggacaataaaatagttcaggacagaaattatcctcactgccagcttattgcagtagtcccagctattaatatatagaacatgctgcccagaggagctatgtcaagacagacttttaagcagatccgtgtcatcttaactctcctttgtggagactttaagtttgaggctgacttcagagaagccccatggcaaacacagctcctagaattcgaagtagagaagtagagaacaggaaccctcgagtgtgtggctgatgggcgtggtgaatccaggtggcttctagaccatagggtgggtcaaggacatttgtagccctagggatgtgtggtctccacagacaccagggctggcagagcaatgatccatgtgaggcaaaaaggaaaactggatcaccatgactaggtcagtggtgttggttcaagctttagagtctgacacccaggcagtttatctcagccgtatttaaggacagcaaacatttggtaatatgtttcctgatgttgtttaactcaatcctatatgtacagcaaacttaagacatgtttacattgaaagtctttgcaaagtacatacagcttctttcttaaagatggttctgttgactgagaaacaattctgaagggtctagggagaatgatggaggaaagcataaagtcttagggagttgggtgtggcctggccctactgataacacagaggttcctacgctgttataaagtgcacggggcatctcccctaagcatgggctctactgactgagaaacagtgctcaagataaagcctgggtagggagagtctgggataaacatagtctctgggctttggatgtggccctgcctacagatagcacaggccatcaggccattaacggcacacattcccagctgtctgggtggaaacaggcttgcatctcctccgttgaggacacaaccctgtctgtttaaccctcccggtttccctggtgctcatctatgagcacaaggaccttttgccctctacaaagggaaggtcaagggatggcattttgcaggattggtggggaagacaatctagcatggaccccaccacggcagacttttactgtagacaacgctggcaatagtgcttccaaatgggaacatggcccaagagcatcactcatacagtcttaagtattctgtggcccctgggtctctccgaggaattctgatgcactggtttctagcgagtcggtgagaagttagttggttcttgtgtgaatgagaaaacagttgctcaccgtctacatacagctatgataaaggagcttttctctttgtgttggtctacacagaccaataatgacattcagagtaaatttagaaaatgaaggttttgctttgtggcagagtgaatacctgccatgcaccaggccccagatttagtcctcagtgtcactccatatatgggcgtggctgaggacagtgtcaggagtggagacatgggtctctacggttctcattacatcacatcacccctgcggtttcttctgcacctaggtttccgatttgctgtctgtccttgatgcagacagctggggcaggtctcaaatgtagttctgtggcccccaaacagaatgttggcacctctggttctgcttacatgtgtttgttagtgctggggtttggcgagcccatttcagttcccttcttctgggacttgagtcacagggggagtaggtgatattctggcggatgacaggacattgccgtcacatccatgtggaggagccaagaggtagatctgtgtgttcacaagcatttctcccagactcaaaaggacagcatctggccagagaaaagcccagaatcctcctgcctctgtggtccaccacacaagctcctcccaccagagaagggttgttctgttctctcagaaggactgagagattgcgacggcactaacacaggacagccctgcacctgcatttgcccatgaggtgaggggtaaggctactcctcagggttcagtgtcctcacagtttgtccatgctgaggccaccatcctcagagaaatgccgtgggtgcctggttttgtaggacacaatcgagttctagctggtttcttcatagacgtatctactgctaaacttcacatggtgtccagttcccccatcctgagtctgcttctttcactcaagacagaggaccggtagcagaggcgttccacggcagactgactgtatgtcctctaagatgagtatttggagtagtttgtcccagcaagtccaggagcatacctgaattgaaagggattcaatttctcctcccctgtgtgcctgattaatatttttttaggtctcagctcagagtcacagccagtgcctttcgtgatgaggccgtccgacatagctcttcatttgttgatgtcttagggagtttcagcgagtgcccactgttggtctcactcctgttaccatggtctgtcttttcaataccactgtgactttcatgagactcagagctccgtgtgttactttgtttgctgtgtatatggagcatcttgggctaacccaattcaataaagggcacagcttccgtgacgagaaagggaatgtggcaggctgcatcaggctgagagcaagggcccagaaactgtttaccactgcagtgggcaacacacgactcctgtctggtccccgaatgtcagatcccagcaggattgttgactgtgttgacctcagttggaggttgggtcctgggactggggttatactggtctaaaaggtgggtgaaaattgtgtctcatgaatggcctgggaattgacagagaagggacacttaaaagatttatgtttactgccttaggtatagagatgttttgtctgtatgtgtgtatgtgctccacatgcatgcagtacctgtagaggcctaaagagggcatcacatcctggcacctggagttgcagagggtcctgggctgccatgtgggtgctggggattgatggccaaggtcctctgctagagcagccagtgctcttaaccactgagccatctctccaggcccttttaagaagtttagaagggccaagatcatcgagagaaaaacacctcagaagatcaggaacattgcctagtgtggagtacacaagggaatttctgcacattgttcaggacacggtaccttgtgtggagtccccatgtgggctatgaggctgtttttctagtcctggggtataagtatggagtgttccaactaccttctggaaggtctgatagtcagagcagtgagagtgaaattcatcttgcagttagtgaacttttttttttttccagacagggtttctctgtattgttttggaggttgtcctagcacttgctgagtagaccaggctggcctcgaactcacagagatccgcctgcctctgcctcctgaatgctgggattaaggcgtgcaccaccattgcccagccagttagtgaacttgaacttactggattgaggtttttgatgaggactggctcttccaggcttgtcctgctacaatgacattggtgagagacacccaagttggagaggtcagtagacgaggactgtagctgtgcaggctggcgcttctgaggtgtgtgtgaatctggtttctgatcaaggatgactttgtatgcctgtccccaaacccgagctaaaaagtattaaacagaagatgtagaatgaaacagagatctgggctttggaaagtcttggtgatgcagaggtcacagaagtcacagaggtcatggggacatgaaaccgttgctcccttgctggtccctgtctccttggctcacctactggtagcaatatttacactgaaatcttttaaaaattacttattattagagcagtgcttctcaaccttcctgatgctgtgaccctttgatatagtccctcttgttgtggtgaccccaaccataaagttatttcactgctatttcataactgtaattttatcactgctatgaatcatgaatatctgatatgcagggtatccagtgtgcaacccttgtgaaagggtcactccacccccagattgagaaccactgtggcagaggacaactccgtgaagttggaacctggagatcaaactcagttaccaggctaccatgactgtcttgtcagccctggaatcattttttaagcacaaattatttgtacaaaataatggctttgtttttggcattctcttgcatgcatataacgtattttgggttgttttcattttttaaacatttatttatttatttaacatcttgactgcgattttctctccctcctctcctcccaaccccccctctccctcctttctgttaatgaacagactatagagctgggctgcaataccatagcctgccaaaaggtgtcattgttccataaatgatatctcagggtagctgactagaagcctttaaattatgtaaatgtttttatttcctctcatttatattttgaattctcaccgtatgaacataaatattcaaaccagaggagatcaaaagctgttttacctaaatctagttacaccaatatagtcaaattttattcagaattctagtcattggtgttaatttcatacagttcaccactgcttaattttagctactgtaatactaagttaccacctttggtgttattttgatatttggtagagacataggtacatcttggagtgataaaaaagtgtgtatttttgactttttttctgtgtgttttgtgggttctctttgtgttcagacgagttttccgtccttatgtcacattcacaccaacacagattctgtttttgaaaataacaggcatatatttgcctcatacctagggcagggtcactgtgtgtagatagatttttaaatatttgagtaaatgaaagactagagttcatttggcattcagtgtttttatactagggacccgaattagtaataaaatgccagagaagacaaggggtgggggggggagggggggggcaggtggtgggggatgggggtcgggggcaggtggtgggggtcagggagttgggggagatgtttatacacacccatcacatacatgtgtgtttgctcagtgttaacaagcctaataacattacttggagactagatatacttagcatctcatgatagcatgtgttctctctgagccctgggagcaaaagcatgcatatctgatatttgggattattgttccctgggactcatgttgggagaagcatttatgattgacagctggctatacctgttgtagcatcttaaattaccctatgtagtcccaatttaaaggtttgtttgaaagggcggggggggggggggggttgtgtagtgtagttttgacacctgctttctccaagacttgtgacctccgtcctgatgtgatctgtgttccttgtgattggtgttactgaattctgcctagcggtaggcagggaatagtgcctgccttgtttgctgccacgaaaagtccccaaacacatgactgcacatgaggacactgcagattagagctgcagggtgtggctgggggagacacggacagctgagccactgaggcgctgagccactgaggcggcggctctgccaacagcagcatgggttatgtaaggcctgcagtgtctggagctgggcttcactggagacatgtcacgtgtgtgcaatgctgtgggtgacccgtgagtctgcctgagataagcttttgcagctctctgtactagaaagcagatactgcacataatctaattccagtaagaacagttgctgtctggctgtcctttgtctgtctgtgtgtctgtgtgtctgtgtgtctgtgtgtctgtgtgtctatatctcgctacgcttctgaagatcaaaaattaagcattatgtaatgtggataaataatgtagtgaaaggaagcaactcagttctggtcactagagaacttatccccacatcacttaaaaatgatttttacaacgactcagcaattattacaaaatacatagtatttgggcattgtttctgggaatttatgtagacagctgccatcatttcccccaatgccatgatctgtggaggagagaaagggagtttacagtttagggaacagtactgagaaagaattttaaattgtgagctcaagtggaattttaatttttaaggtttttaactttatttgtgtgtgtgtgtctgtgtatgcaggtgcccacaaaggccggaattgggtgtgagaccccttaagagcagcggttcttagcctgtgggttgtgacccctttgggggtcaaatgatcctttcacgggggtcacttaagaccattgggaaacacagatattttttacattatgatttgtaacagtagcaaaattacagttaattagcaatgaaataattttatggtgggggtcaccacagcacgaggaactgtattaaagggtcctcgccacgaggaaggttgaaaacgcctaccctagagcctttgtcaactacagacccatcttcccagcccctcaaacagcctttcagattttatctccttactgaggttatggaatcgggacctgtcagaaatgaaccctttgtatgcagctgagtctctagactgcatctcccagaaggagatctgggtgatgccggaagacagcagcggtcagtgttgggagactgaagcctgggaaagagggtgagggctctttcatgtgaccctggccttaaggagaacccagaagatagccaaactccagcttggctttcctgaccacctctggcttccatgctaatgtctgtgagcagaaatcaaaggccctgaacccaggtgcccggagtcctccagtctgctgagtcagcagggattagtggcgcaggtctgtgattttgggtggattctcttaaactatagcaaaaccaatgttgtcctattttttccccctcttacgaaggtcttttatttttgtcttattctttaaaaccttcttgggatggtgctggtttgttgaatgccactttctcttctgacctcttcatatgtagattttgtctaacagtcaggcccagattatcaccattagctctttggtagacgacctcacccatgtggaacatttgacacacacgtgtgtagcttactctccctgtcgttggaatgcatgtttgtaggaggcatgattagtccattgaatgaaaggaagctggacagggccaccctgccaagaggtgacagggtgtgggctgcaaatggaccctaagtgtttcacccggctgtgtgaacggtccacacccatggttactttccagggccgtgctgactactttcatttaggatgtaggtcccagaaggtctgcttttatttttttaatttccgtgtgtgtgtgtgtgtgtgtgtgtgtgtgtgtgtgtgtgtgtgtgtgtggggatgtttgtatgtgtgtggatatgtgtgggcccaagatgaatatcagaaggcatcctcaggtacccttctaccttcttcctgaagcagggtgtggcagggagaccagagccctccccatggggctgctctcccagcttgctgtgcggctcccggctcccgtctgcctttctgaggttgcaattagagcacacttcccatcattcccttggattcagggagccggagccccgccctcaggtttgtagggaaagctttttgtcttctgagcatctgccttgctagccccaggggtgctctttaaataactccctgggtggctctgatgtgacaggcatgtcagctccctgtgtatcggcatcagagcacagacctttatgctgagcttgtgatgtggatggaaatggttgaacccgccatgtctggggcagggctcagtggtgaagagcacatcctctcctgcagaggacccttgctcagtttccagcgcctcctggaggccacaacttcctgtaactctggctccaggggatctgttactttctctgacttcttgcgtgttcctacatgcacacagtgtatgtccatatactcaggcacacacatatacatataaataaaatagatattaaaaaagaattttgtctaatgtgattttgtggtataagccactaagagttaacccagagacaattccaaggttatgggagtgtgtgtgtgtgtgtgtgtgtgtgtgtgtgtgtgtgtgtgtaggttatatgcaaagaccatgctgttttacacgaaggcctttggcactcagtgatgggatgcgcgcacgcgtgcgcgtgcgcacacacacacacacacacacacacacacacacacacactgagtgtacatgtatgtgcacatgtgcttttccattcaccctgtatgcttatagccaaactatgcacatagttcattccttgttgtttcttggcgaaagcatagtagaaactataccttgttaggacagtcacccagtactcttcggctaaagctgtggtgctactctttaacagctgaaaggacacagtaggaaatggcttgtgctataaaaaggctagctagcctccagctctgaaatcgagactcagtgtaacttggttaatgagcagattcagagttggtctaatgagttgctgacggaagggcagctcgttatcaccagccagtgaagttttgctcttacatctttacacagtaataaaggagctggctgctctgcctcctgccattgattctggcttcttgtttatatcttttcctggttttatttaaatgatagaatagatctatccctgggctggggtctgggctccccaacctctttcttgtattcacccccccccccacattttgtttgcaatgatcatcttgttttatgtttccatatttatttcaaaggtggggagtgttggaaaaggcaaaattaagtctgtgattcaggacccctcagcaccatggctgtggccttgtaagcgtcgtagaggactctgaggacaaggaatgaatgtaaatgtttttctaagaacgtggtcacaatggtgcacctgtctgctgcacaacaacccagaataaggtttatattttttaaatttaaattttagtatgtgtaccacataataaagcaacccttgaatattattatggttgctgttattttattaccccacttatggaaatcttatgacttgtacacagacagtggtagaggacttcgtggactgcttggttagtgctgctcatatggccatgagtgtgagctcatctatggacaacctaccagcgaccgctcccttcctccagcagccatcaaagtagctgtcagtaactcctgagctgaggcgaggcctcagtagcctgtctctctctcccatgataggactgtgaagtgtgccctgatcatgtgctgtggtgactcataaccgtctcacccagaaggcggcattccgcagaacccctcccgtgctcttctaagtccagttctccctgggccttgggtgtctagtttgatggaggtgggtcctgggtccacctggaaatcttcttacaacttgtacgcaaaccatggtagagggctttgtgggttgttgatactgggagagtcaacttttctttgcaaatgaaccaaatattgtggactttgcataaatgttggagatgcccaaattgtgccctgaatgaccatggtaacgaggcaaaggaaccatcgttagggatcttgcttgggtggagttcatttgtctgcttctgtccatagaaaggaagccgctggggacaaaatccacatctttctggcattttccaagaccctattgctgggttaacagagtatcccacccaaaaagactgtgctcagctaccccagagagggatgtgtgctgttcctctgtgaaccgattctctccggttcttaggtgcttccacaattttcaaagttacagcagctcatagaagatctagaccctgcagattgctaaccagtcaaactcacaaacagtctgtgcttagaacgaaaaagagttctttgatgtgtcagttgggcttgaattaggatatagaaaagaaacgacaccttaacaagaaataacgacgtgaacattcaacatggaacggaagcagtgcatgtcagaggaacactaatagcaagactcggtcacggtaactaggaaccgaaacaacagaatgctaagagaggactctgaagtgcccgcagcagtttcagaaagcagccgcctgtacccagaatagagcagagggctggactggaaatagcagttacagagcctgcctgtgactcagtcatggagcacatgcctgtccggcatgcagaaagcctggttcgatgttctccaccgcatgagccaggtgggtgatgcacacctgtcatctcagcactcaggaggcggaggccagaggatcagaagttcaaggtcctcattggccacataatgagtctgaggccagcctggatacagaagaccctgtctcaaaacaaagccttggaggaaagccctgtggccgcctacctcagagcccagaggcaagtgccatggacagagttttctgagggaaaggcaagtcactctggtcaagaaacacccttgacctagaagaacttgtgtctggggtgacataggacacgtacaaaagcaggaagccacatcagagccaagtcctgctctcccgagctcatgtgtggtgcaaaagcagttgcttggtcactaccaggatgtttctctgagacccttaagagaactctcgcaattaaagattggcttaaatatacaatttgatttgttaacacatggcaaactataaaaatacaatgaggccaggtcctctcctgccttcttgccctagccctggttctccccccccccccccccccctctctccccccccccctccccccaccacagtcttttgagtcttttcccccagtgttgttagcgtcttaggcgccctttcaagtgtgtgcagactcaagccaacactaatgcagacccttcgatgctataccacatcccgctgaacacagaagggctttacactgcttccccaccagcgtgtcttcccatctcccctgatctcttcgtgttttaaatctcagcactttgagttttcctactgtttttattgtctttggtacttataggataaaggggtttatctaaaaatactcacagattaaaaaatatcttcaagtcaagtcttctggctaattgttttggactgtacacatagcacacgtaagatatttaagatgatagcagacatcttttttgtcatctcagcttcattgaaagtgtctagtatttcccaccaaatgtaatactggcaaagcgtgtttcattttgttaacgaatctcctatctgcctctctagttctcgtcggcctgtctgtctgtttatgcatattttgtgtatacgttgtaatcagaatgagattaagtcttgccagacggctccagagcatccctgtggccatgaagcttttctttttatagttatctcgagcaatgtgttgccctgaactcaagtttggttaatgtttcctgacacttctggtatcgagtgtctttgtggctcctgggacaaactacactgggttgtggaattcagtggcaacacgagtacatctgagcgtggggtgatgtttgtaaatgtctagatatttttgctctcaatcaggatttttaatcacttttacttatttcataagacgaacgtgggtagttttcttattttcttctaacctgcagcagtaccatagcactgaagagagctccttgtacatttggtggaacttccctgtgaaacactctgagcttgggattctgaagtcattcctagacagttatttcttctgtagaaataatcctgttaggccattttctgtcttgtttgatttgatttgggcaaatcacattgttcttcaaaactcacacattttatccaggcttgttgagagttaagttggtcagagcagatcttacaattattctccatttcttttgttttctttttttccttttcagaatgttttgtgtaaagtctgttctaaaatcaggctgtctggtggccagcgtctttctgctttcaaagagtgtgtttctagaacgttatcgttgccgtttattcttccagcaccgcccccacctgcttctgcactgagccccgtgtctaacaaccagcttccccactgactcctacgtctgtgtggagcccacagtctcttccttctccctttcctccttccttctcttccttctccctttcctccttctcgtctcttatgtttccatgcctttctagaaattctaaggtttagtttgggtttactcttgttttcaactaaacaacgaaaccaaacaacaacaacaagaacaacagtttgcagtcatcctgtgggctgtcagttgtgtgtctccaggcttcctctgctttggtacatttgtgcgctgtgtccttcaaactctgtcctggtcgtcatcgtcatcgtcttcttcttttccttttatgttcatttaactttcggaggaattgcttatgttgctttgttttctgcacccctcagcttcctagcttggttttgtcgctaattatttgttaatttctgaagacatgattattactttaatttcctaatatttttaccatcccttccttaattatgttttttggttgggtttttgcctttttgctttgcttttgttctgcatagtgatattgctctaggggtgatgacagcatcatttaagagtgatttatttatttttattttatgtttggcctgcatgtatgtctgcgcaccatgtgcctgcagtgcctgtgatggccagaagagggtgtcagattccctgggactggagttacagatgtttgtgaactgtcttgtgggtgctgggggttgaactctggtcctctaggagagaagccagtgctcttaaccggcgagcaatccctctgtctccattaacaatagttttacccagtaaaaccagcaaaaacaattccaattattttccaaaccatattcttttctatgtgttgtcaataaccacatttaaagaagctgtggctaaagattgctttaaaattaattttcctgttaagacatagtttcttagtagcagaaagaaatagatgaggtggaacccaagctcctttggtgggctgtacatagtaggtgagctgcacacagtaggtgggctgcactcagtaggtaggctgcacacagtggcagctcctgaggctgaaagctctcagataataacattggttacataagtcacccaggatggcccagtgtactgttatttccagacagccctggaagaaacatgtgccaggcaacaggccgtcagacgaaacataacaatttactttccgataattatctttgcttagagccaggttgggacttgattgatccagtacagagaaatgtcttcttgtatggatttctttcgggattagaaatacgactgccatgaatattcctgtgaatcactaccagggcttcattagaggaggcagctgtgtgtgagtgcttcttcgtcctttgtgtgtgagactcagctgatacaaaccctgacccaaagtgtccaccattgcccttccctccctcccatttccttttttgtcttttgaaacacgccagcgtgttggaagccttttccgtgaaaactgacaatgctaagagcccaactgaaatttacttgctagttgacgaatcacagttcacacagcagcacggctccgaggcggaggctggacccctagctatactaatgaggggccttcgcttctcccaccccacaccctgtgctgtctggggctgctctgtggtcctgatatgggccagactcaggatacccctgctttcttcaggttactgtattcgaaggtggtggccccacctggtggtaagatcagcaatgcagtctggtttgctctgtctccttcgtatgggggaagcctagccttggcaagcctcggctggcagtaaagctgagagtcatcttctgtactattgacaaatgcaggataaggtttggtggtcttttcgatactcacgttgcctgggaagaaaagctcccctcaacttctccccagaggttagactaggagcatgtgcgtcctaaggagtctctattctgatggaagcagagccctttcaggtgcaggctccaagtgactctcataacccatgaggccttgtgagtgtctgcgcagaggcttagagctaaaatcctctgctggctgggaggtctgacttgggaaatgaggcagagggcaggggaggcgaagaggtaaccatggattcgttcccagtgtcaaagccacagactgcactgacttcatcagagacacaagaaccagtgcatggcccggcttttctgagttctgaaaacaacgtttaattatgaaccctgaaagtggaagtgtacagaaaggattggaaatagaaaagttgaacgagacacgcttagacaaaaagtaccgactgtctactactcagtcccagagacgcactggcaagcaattaattacaccctcagagtttagtgagaaaatagtcatgaaccaaatatttggagagggattgaatgctttaattactccaggggaaaagttcagagtgttagacgggtgtgtaacacgggataaggctagaaaggagtgtccggaagaattggcgtgacacgataaggaacagctgctgctcggccgtgaccaccctgtgatggtggtgtcagttgaaagtcctcttcctctgagaggctggacacccaggggcagaagggcagcagggaaagaaagagagtggtgagccagccgggggacagcaggtcactgcagggaaggatgctggcatggggtgatgtccgtgctgttaggtgttctctaggctgagctgtttttttgtgaacatttaccaagctctgctctcagcacttcatgtgaacattttctgatggccgccctcacagttgtcttcatttcatatgaaatgaaaataagctgtgttcttaaaaaacaaatagttgggaaggaaacaatacatggctcaaaagatggctcggtcggtgaagagcttgccctgctaacacaaggaccttagctcccataatccccagcacccacacaaaatgccaggggtgatggtgtgacctgtaatcccggtgctgggaggtcagagacaggacagttcctgagtcttgctagtcagccggcctatctgagtctgctaactccagggtcatagaagaccttgtctcaaaacaaatacagtggggaaatgactgaggatgacacatgacatcaacctctgcccccacatgcatgttcacacatgcacacgtgtactgcacataaatgtatgtatgcacacatacacacacatatacatgcacactgaacaacaacacagttggttcttgctgctaagcaagttgttggcttcctgtgcgtgtcacatgagagaatatctgtgacatgcttctggtacacagtgcagtgttcatttaatttgattagaactttaattctcatcttgcccttgctggtctctctacaatgtctagactgagagatacaaagaaccccactggcttcctgtgcggctcactgcctttgccgttttatgacttgtttggtagtggatttggggtcatggatgaagctgatgtcaggatttggggacatggatgaagctgatgtcacagtcagctgatgtctttttcctcctctaagcatctttgttattgttatagtttctgttacagtgtcttgctatgtagcccaggctggccttgaactctgtagcctaagctggtctccagctcctgatggtcatcccgcctcagcctccttagtgctgggatgaaaggtatgtgccatcacacagtcttccaaactcctggagatgtaaatcgacaggctggtcaggtctgaggtgtgggaagtgtctccattcttagggaagctacacatgtttgtctcatgctttgtttaattctgaaactcttggcgaagactgctgttgcttgtacgccacatctggaagacatgtcgtcctatttcatgggaaggaacagcgggccgtgggcggaggagcctgggtgtaattacagtgtgcgtttatttggaaagactagcatattagcatgcagtgggaggattaattaatctcagctggaataattctctgcagttggtttcaataaaagctgaatatctttaagcccttgaggttcgcattaaacttatgatgaaagatatgtttcaaatgtccctccttctgacacgagtcctaaacggacatccctgatctgagatccggcttttcctacctcctccaaaccttacctactaaccgatgaaaggaagtcaggcatcttcaagaagatgagggttttttgttttgttttgttttgtttttacgcttaaaaataaatattttgcaaagcccgatttccacaaagttgtgtatgattttgagtttctcctccgggtgtgtgaggtttccatagaaactgcctcgcctgtcttcagagccatggactgtcttcccacacaggtcaggaagcgagcagtgccagcccccagctcagattattgtgctctcccaagtggccggttcctaattggcacatgcaattccatatttaattagcagtacgagtctcactacactttaccagcagatgtggcatttagaacgttggccatcctcatgcagctgttagccagatgtgcctcagagaggaggcatggtcacacaccacagctcagctgcttggcaaaaatctgggcagaggcagcattatttccccttaagttaaaagaaaaaagtaattttccttaactaggctagtggacttattttctatttttataactgctttattgagatactcgtgtcataaatttgtcccaccagaatgtacaattcaggagttagtttttctccctctctcccagtctttacagcaccagctcctggaagccagctgtctactttgtacgaatctttgtgaattctcctgttcccgatatgtttttttttctaagttttttctcattgttcctgtgctgttctcagggcttagccatggggaggcttgtgttagtactctgggccttttttttgagaaataacacaccatggtatgcttatagtgcatgctactcgcctactcatcattccgtggccatttggggtgctttctgctctttgactgttaggaatgctgctgcttctgctatggacatttccataccaggtttttgtgtgaaattcttttttgagatcaagtttcattatgtagttcaggctggcctcaagctaccaattcctttgcctcagccctcttgagcatgggaactatagatgtgaaccataccctgtggtgacattttgtttatgatctaacaaataaaacttgcctgaaaatcagagcgcaaggccagccacactagtcagtcacagaagctgggcagtggtgacacacacctttaatcccaggactcaggagacagaggcagatggatctctgtgggttcaaggccacccagggctacatgagaatgaatccgtctcaaagagaaacacaggtgatctcagcacaccggatccctggcctttaatcccagcactaaagaggaatataaggcgggagaagacaggagcagaatgagtctgaggtttggtggatcgccccttcgttctgctcatcggcagaggtgagaactctctagtggctggccgatttgtttctcttaaacaaaatatcaccacaatacccaagtttttttttttttttttttttttttccccttggtcatgtgctaaggagtgaggtccctgggtacaaacataactctgtgtttaatgtgtggggaccgtgacatagttcctccgcatggctgctctattttgtatctgacccataagttatgaggttcgtaatttgtccacatccttgactgtgtgctgcattgttaccttgtaaatcttaaccatcctagtggatatgaaggctatccaggggcatttttttttttttaaaaagaaatcaatatctagttcacaaaccagttaaatgcttcttatttatgtttccattactctggagagttgagggaaatgcacttcttgtgtatatctacaatgttattttcttttctgattttaacacaaacccaactcagggaagatgacgttaaaaaaaaaaaacaaaaaaccgatgattctgggagttggactatttggtaggcctgtagtgtagaaagaggaaagtctctaagcactgtttgaataaaaggtaaaatcttcaggttcctggtataatttcatcttacattagccaaatgggccatacagtggcatcatacagtggcgtcatggagtgtgaagcacagtgacgctgggccaaagaccttcagacagggatgcagctaggtgatagagtgcttgcctagcgtgtgtaaggtcctgggttcaatcctagctcccaggattgaacaaatgaccctgatgtttcactcaatatattttatcaggtgtaagaccaaaacctctcgtatcactaaaaagcaaatcaaggcttccagagtctgtagcacactgttgactttaaagtgacctgtagttggtgaaggtcagtgttgaggaaaaggtgtgtgctacagctaatgacacacggcagcacagcctcccgtgcaccgtgggatcttaatgctgcattgagttcatcaccaccctgtacacatacgtgcactctcagcccatattgggagcatctgtgtatctgtatgatatatacatccacacatactagagacagaaaaggagggaggaggtaatgtgtcggctcagcctcgacagactgaaatcatcctcaaatggctcactcacctccagtcacacttggtttgagttttcttagcctgtgaatagtgttcatgtttcaggtagaaactgatttcaaaagcctgtgacgatcacgtgtttgatgcaactggggaggttggggaggttgcagctgcggtccccaacagcgtgtgtgctgtgcactggctgttgttaaaagtaaataaagtctcaggactggggcctggcttggtggataaagctcttgccatgcaattgtgaaggcctgagtttgcatcccaaactcgtggcaaagccaggcaggcatgtgggccacctgcagtcccgctcctgggaggtagagccacggactcctcagaccaggctggctaagcagaccccagaaaacgaaaacataaacttcagtgagagcctctgcctcacacacaagacggagagcaagggttatggagacacacctaatgtcaagctcaggcttccacacacatgcatgctcacacacagcacccctacacacgcgcgcgcacacacacacacacacacacacacacacacacacacacacacacacacacgcccacataggtgtgagcatcacacagaccatatgcacagacacagaaacataagagaaggtttcacctattttagcattttagttactgttctagatacagtagtaaaatacctgtcatggcataatgtgtgacacagagtcaagatgattttcagtactgttcaaaagcccgggaggcacctagcccaagttctgaacaagctccgtcctgaggcgggcagccagcagtgcttgggcggtggcattgttctgtttatttgaactgagatctcattttctccaggcagtaaccgtgtctgtgttttaagatgttgttagatatgtgagaaccctgttgtttattcctcctcatccttgtctgtgtttttgctgtggagtttttcaaaagtcatgctttctacacagaacacaatcaggagctcacgagagcatggactattcatattaacaggaaaacgtatgctcttaggagcaaattaatgtaggaaattattaacacttcatgcctgtaacactcaggttgagatcaggctacatagcaagattctgtcttaaagataaaaacaaaaattaccaaagttagatcaacatgattcatacagtattaaaaacactatagttgtataatacagacttgcaagaaatgcaacagtttttactttgagaatcacatgggttgacagattgcattaagaatattttcttttagaacagcattttaggagaacagtggctgtctgtctcattacactcacagattcacgtgacattgagttgttagtttgggaaatcagaacctcaagatgggcctgtgctttttagaaaggtgaaaatcctgggccagttgatagcacagcaggggtggatagggctgggtgagtatgcaggggagcaaagggctgtgtgagtgtgcaggggaggatagggctgggtgaacaagcaggcatagagatgagaacaagacagttagtactgcctctgatttgtcttcccttagagatacgtggatatgtagagtggtttttatgcagcaactggaacggcgcctgtctctgtggcccaggcattctgatgtccataccctcatcacttccctggacaaaagcttgcttttctttaaccattaaagagaatgctcaggagctgtctgcttagaacttgatgtagccaaaggcacaatgtttctcacatatataacccccaatctttaaataatactgaggtttggatattatcatgcacagtatctgtaactgggtctcaggacaggtcagtagaattcttgagtcacagtgctagtatgtagctaaacccagacctgagccaggtggggaggtccacacagaatcagcaatttccatcatgtgtgtgaccttgcagctcaggtgggtctcccaagatgaagggctggaccgtgtgtgtgtgcgtgtgtgtgtgcgtgtgtgtgttcttaattctcaagaacttcctttgaagttgatctatgcagagttcttcatttcatagactccacgattatttctcttctacatgaaaaattctaaatttaacctgaatttattaaaatttagcttcctgtttcctttgtcaaacatttgcattgattgacaggtattcaactgttgctttgctcctgggtgcgaagtacagtttgttcttagtgttggggtatgatgagttgtttctcattcttgtgcacatcggtatgtatgggtgtgtggtgtgtgttgtatatgtacgatgtgtgtatgtgatggtgtgtgtgtgtgtgtgtgagtgtgtgtgtgtgtgtgttgtggtctataaatgtgctggtgtgtgtgtgtgtgtgtgtgtgtgtgtgtgcgtgtttctcagtgtctgtgaatggaggggggggaatggaggtggtggtgtgtgtgcacatgtctgaatgtgtgacggtgttatgtacatgtgagtgcggtgtgtgttaggatgtgtggatgtgagtgtaggggatgtgttagggtgtagacagtgcttatgggtggggtgtgtggtgtgctcctgccaccctgttttcttggataactctcctgagccatgagatctcacaacctggccagccgttcttccctggctgcacatacagaccacagcctgcagctcatggcttgtactccaggaagacagaacaggaaaaaaagagagtgaggtggagcctctggccccttgtatctacagctcctttctccctgtcctgccaggtctcagggaaggccagtgtgtctgtctgtactcaggaaccatagctggaggttcactgtcccaaccaccacaccgtctaatagaagggaaatgggaattagcatgaacgagatttctctgaagccagtttgatgtgtcattagcatcctaaaaacaacctgtgtgagtgatgtatgcagaggaattctccagaagacagttgggacttcccttgaactagtatgagaaagccagctgctcttgcctgtcttgtgggaaaagctccttacacttccttttcttataggaagcactgggtgcctattaaatgttccaatggggtggccatgccctgatgagtccttggcaaccccgtgctccccacctggtcccgtgggcacctttaaagcactaggtggtgactttccccagttcaagaggaagaggcctgccgtcaggtcattgccagttccttctttgttcccacttcctccctgggccttggggacctgccatgtacaaggtcattttggacctccgaacccttctagctgcatactctggaagcttagcagtcacccctaggaattccacattggcatatgaacacaggctgccattggccactttggttagatttccgaggcagcttaaagagacattgggcagcaaaagaccagtctgacctcaacagatgggactgtctatttcaaaacagccagtggcagacactctgtcaagggcaagggagtgcctgcaaaggcgggaggggatgcctggagttttggggaatggagggtgaaatgtagctgctggggccgcactcaagcctggagtagtttgctcagaaaagggcatttcatctttagaggttgtctttccctggctgtcaggatgcttccaggtctacccaagctgacgagtcgatgatgtcatcattaatgggaaccccaagtcaaatgtctttgccagttgaaggattagagtttgaggacgttggcatatggtgttttttgtttcatgaagtcttggttagattccttctaatggggaacatgcatccgttcactctttaagggcttgggaacaccctcagactctcacctcatagcctttcatgtctaaaacgtcaaacagtgcactgtttttcaaagtgagtgaaagcctttatacttttctaggataaatgcttatttttctccattctgtccaccaaagccagccgcttctgggctgcttgatttctgataccttggactcggcctaacatagcagggagaggccaggaaatcaaagagacccggccatcttcccatgtgtccacatactgctggcacgcctcttccggacatggacatgactttttatggagacattttgttgtaatttcagaaggtggttgcagttttcttggctccattaacagttcgcacatctggaatgtgttcctgtgaagatgttggctggaatatgtgtcttgtggcctggagttgcctctgacagaaagacagccacagaggacagtccttgctagtgagtgggcctagcccagaaccttctgtgggaggcccgcagaggaagacccagcacagaggtcacgcagctcagcccccgtgggattatttttaaaatggcattttgtatgtttagttctgtccttactctctgccgtggcagttatagcttggaaaggatttaacaacccttgcaccagactatctgacagattctacaattattttatttggcttaaagggatttagggacatgtctcacactgaagctcctgactctgttccctgccagagagagaacagaccacggatggccatggcaaactgcggcgcagcacttgcctctggaggaccaggatttgataaatgacgccagcgtgtgccagcacttgtggtttacttgtctaccatgatgaagtagggatgactgccttagctaaaaactggccttcaaaccaagatagatttatttccactttatttgaaattatggagatattttctatagtgatgtatgcattcgtatttaggcacctgtcctggcccgcctttggagttctgacaggatttctgtgcacattcactattgttcccttttaaaagggccctgcccacctccctctctccgtccctccatccctccctccatccctccctccctccctccctctctctctctctctctctctgtctctctctctctctctctctgtctctttcctctctccctctgctcctggtcctagaggccagtctcacccctcctcttttccccttttgcaatccttttcccttaataaaaaaaccctgctcttgatttgtcacatggtgtctctctctcttgagtcgctttttaaaaattacaacagtatgtacatgctttggactgacttttctgtattcactcactatgattaacagggaaaagctagggttttgaggtagttgataattttttccctcttctcaatataaacttttcacttctgtaggaaagtttggtgtgagctcaggaaatgtacatcagtgcaaagccctgtgcttctgtgtgctcggctgtgttacacggcagggatgccattgactttgctcattgactttgtgtccgcccttagtccacactgggaactatgccgatcacagaagccacaggaagaagggtcaactactgcttcatttgacagctgagggctgaggctcagggtggtgaggtagcttgtgtgagatcccctggttaatacagcacgcagggacatttgaacctgggcactgtgggtccataggaggctcaatcgctgtcttccccattctgtgacattctgatatttgtcgggaaatgcaccgtggaccttctgagtgctgtggacccgtgaaggaggctttcttggtgactggtgcttaccagcctgttttacctgcctaagagggttttacagtgttggcaaatataatcattattttagcgtgatgtagctgttctgctctggattttaaaaatactttattcttcttaacctataagggatgctttttttaaaaaaaaagcaataatatagtgttaaaacatttttggctttatttctggcaaggtctctcactcactctgtaactcgggttcctggaactcactctgtagtgctggctggcctctccttcatgacaatcctcctgctttggcctcccatgtactaagtctatgggtctctcttcacaaatctattatttctcttcctcttcctcctgcctgcagtagaagggtgatttttttttcttggttggaattttggggaaatatattgaaggtgtgaatgacagcttcttacagaaaccgactcacaggatccagacttgactcacgacaggttctttgtggacaccaacactgactgctcaagaagagagcttgcttcaactcctatcttcctcagtccttataggcaccccagcttgtcttgtggggttatgccaaccagtgtgtgtaggagagacatgaatagtgttcatgacaggcagggcgactcttaaatcagtgttttctgggcatggtggtgcatgtggaaccccagcactctgcaggcagaggcaggaggattgcaatgagttgaaggccatactgggctctagagtgagactgtctcagaacagcagcggcagcagtaacggggtggcggtggcagcaagacgacaggcctcaggcttccaggtctctctgatgacttcagtcccagtagtgagtcccaaaactctcatggcctcacctcctgccattgagagacaaaccaaagacatgtttgtccctggttttggagaatagttcattagagagacagagatagtttcttttaagggacccttccttaaaagaaagaacagaggaagtaatgcttatttttagctaagagcatccttgggctccttgggtggttttttaaaagatctactttcaataatgtgtgtgtgtggtgtgtgtgtgtgtgtgtgagtgtgtgtgcacgtgtgtgtgtgtgtgtgtgtgtgtgtgtgtgtgtacattagtgcagttttcctctgttgtggagattctcttgtcccaccaggtcccactgcttcagccccaaatgagtatacagagacactatattaattattaaactgttagctgatggctagggcttcttattggctagctctgtcttaattattaacccataactactaatctgtgtatttctacatggtcttggcttactaagagaatgcccagacctgttactcttttctggtctacatggagactgatctctggcgggctctccacttacctttcccagaattctcctcatctcctagccccgcctatcttcctgctaaatagatttttatggactttccccatcatccctccaatgccctggagccatgaactacctgacatgaatgggtgctgggaactgaatccaggtcctttgcaagagcagccttccctctccatcgctgagcccttgggttctgtaggtctaatagaggacagcggaggtacatccatggggaagtcagctctccctccctagtctcttctaagccttggcattacttttatgtactgcagccttacatgaaaaggtgttagagggagaaaacacaagatgagaagcagtgacagtctgtgctccaagaataaaagcatcaataaaatatcattgcaaaaatgaacaattgcaggcacagagtccatgaagttctcagcgcagtaacaccgggggcattctgttgctcactgggcaagatcatgggtgtgtgtgacttgcacagcctgctggggtcagcctccctcctttaagggcttctggagcctccagagcctcacacataacagtgaaggagcccatctcactgtaaactctttaacgctgtgttggttactttactctttgatgtgatgaaatactcaacaaaagcaactcaaggttgggaaagtctgttgtgactcactctgagggtgcaggcttggtggcagggaagatatggttcacaagtgtgagtgtgagggctctagtgacaagtgacatcacatctataggcaagaagcagagggagatgaatgccttttccttttgattaattctgagaccccaatccatgagatggttctgttcccaataaggaaggtcttccttccccagtcaaacttcctggaaacactctcatgggcacacctagaggtgtgttgccatggtgaccctaagtttaatcaaattgacatccaggaagcttctacctcttcacttggaatggtgcctgaaggagtagctcccgggcagcatggagaccggagagggaagacaagccttgtccttacacaaacaggaagatgcagaaaacataccttagtttggttcaaatatagcatcaaaggcacccaggagctcccatgcaaaggtaggattcagaagccattgtcagcgagcagccggggtgacggtgttgctcttacaatgactcaatgcagagaggaaaacagattcaagagagaaggaatgttccattctgagtttcccgtgccagtgcaagacagagacaagaaatccaagggaagcaacgagaggcttaggcaagcgagctcaggggcacagcggctactgtctaacagagaaagagaagccactgcagatggagagagggagggggagggggacaggaagggggaggggatagaccaacatcaggacccaggggcaagcccctaggttctaggagtcagatgtcacagcactggagaggatcctgtgagatttggaggggcgggacatatggaaaacactagggaatcgtggagcaggcacctggacatgcctggggtttatagacacaagagtgcatccctgcttgaggcctgtgaactgtgtctcaggtttcttccctgaaatatggggtaccacctcaggagcagggctagtgtcagcagctgcaggcaggagagcaagtatatttaccttttcaagtaatttccagttagcatagactataatggctttcctaggacattttatatgcatttattgttctactttgttcgtagcccccaccctcctctctacacgtccctgctgccccctctcacaggtcctcccacccgctaatagcccctcatctattttcatatgtgcacgtatgtgcacgcgtgtatatgtataatagatgtatgtatttgattctggattccctatgtgagagaaacatggtattttgtttttctcctcccccttccctatttgtacccctcgtctccttttcctcctcctccttgttttaaagtgtggaagacaggattttaaaaagtccatttatgaagacatatactgtcctttgcctgctgtctgtatagaacccagccatagagtccactttattttgtcaagtttaatgttctgagcacgagctgtattcccagctctgaggcttcagccttcagtccttagggtgtctgttatcttctctgggcactatattctcagcactagaacccccagcttttcccattgagcaaactcacgtttattacactgatttaatgtgtgtgtgtatgtttggggggtcatgttcacgacacagcacatgtgtgtaggagttggttctttccttctactgtgttcgtgcgtcccagggattaagctcaggttgtcagacttggctcaagagcttccacccactaagtcatctccctggctctaaatataaatgtgtacatacacacatacatatatacatacatgcatgcattcatacatgtataactggcttatgttatttatttgttgtgtgtgtgtgcatgtgcataccacagcatgcacgtagaagtcagaagacaactttcaggagtcaggtcaggtttccccttctacagagtgcatcccagggtttgaactcgtgtcttcagactagacagaaagttccctcacccactgagccagctctacggctctccagtcagcatgtgttaattgtgtacagcttgttgacttctgggatgaggggacctcatgatcactcacttcatgattataaaattgattaccgttactgggacctttgcagttttccctcggaaaatactgatctggcgtcaaattattttttttcacgtttttgcttcagatacatttgcatttagctgtcagccttctttacttgtatttttaaaaatgatgacagctctccttttccagggtagcatactccggaaaatcctcttgaaccgctacttcaaaggtgaccatggcgttggtgccaatggacctctgtcaggggcctatgccaagacagcacaagtgggaggtacgtgttcttccacccattttagggtctcacggcattatcttcatggcagtgctgctccgctatcttagttaaatgatccaagtgtaaaatattcacgtaaaacacgagtgaaatgtttgtgtagttggggttcatgaatccatccataggttgagcattatcgtggattttgtctttgattctgggtggtttcctcacaatttcttcatgcacgtattaaagacaaaatttgtagaatatttttatagagatttatttatttttatcttatacatatgtatgagtgcctgccatgtgtgtctgcacaccacatgtgtgcctggtgaccattggagtcccttgaattggaattacaaatggttgtgagccaccaagtggtgctggaatcaaacccaggtcccctgcaagagcaaccagtgctcttaaccaccgagccacctctgcagctctttctagagtacttaaaggaatgacagttggtgacattgaattgcatattggatgtttaagagttccatctttgtagattttttatatttgtaactaaactctcctgtggctcatgttgttatggtttaagaatttgaaaacactgtttgctgctaaaaacaatgtctgtgctgaagttcgagttgctgttctgtgtttctcttccccgaccacaggaggcttctctggacaggactcggacaagatggggatttccatgtctgacatccagtgtctgctggacaaagaaggagcatccgaacttgtcatcgatgtcatagtgaacaccaaaaatgacaggattttctccgaaggcattttgcttggcatcgccttgctggaaggaggaaacacacagacccaggtgctcgtctgttgctagtgctgttcgggttgtgatttctatatatttttaaagaatacttttgtttttgagaatttcatacaatgttcacatctcctgtttccactcctctctctaactcttcactatccactccgccccccaaccccccctaactttgtgtcttctccccctgccaaaccagtaaactttggatgacagtttgtgctgctcagataccctgtgtgccgagccgtcttctggagcttggttaacctatcaggagccaccccttaaagaaaactaactctcctgccccagcagccagatcacacccacagatcccagccagggttgagggcacacaaccttcccacccaatgctggaacactcactggcttggccgcgtgcggacagccacaaccgctgtgagctcatgggtgctgtggtcctgtttttgctctggtcctccctgacctccaactcctatagtctttcctgtttcttgatcactggttaaaggaaccagggaaacgtatccttttagcttccccttgctggctcaaacaaaatgaaagaactcacaaatcacatttcccttataaatttatgtgatttgctattgaaatgatagggcttcccccttgctctaatcagaacatcgtttgaagctcattctgcatcaggagccactccacagtggcagagggctctgtgtcacgcactctacggtggcagtgggcgctgtgtcacatgctctacagtggtggtaggtgctgtgtatgtgcgtaccaaggacatgacactgtccagctgcactcctgtcccttggcgacccctgccaggttctgcttggctcctttgcacccaacagtgtgctgcacgagcccgggctctggaaacttcccagggagcacttctgaacttcctggctcactgaccttcctatatcttcctaagccatgaagcaatgcatagccccagatggctagaaatccccaaacctattggccccaggagcggcaggcagaagcccagtcagattcaaaactggggtattttgctttaatttgttaccggtacatttaacaacaggagcttttctgtatgagagaccggtttgatagcagggctttggggacaaaggctgaagagacagcaaaaaaggcagcagtgtagcaccggtgtgaactggcttgaactggcatctctagcaacagtcacccagctgcactttctacatttccctgggctgcagagggtcatcccaggggaacgctcttcatcctcacatgggtgccgatggtgcgggctagctccaggagaactccaggctccacttattaaatgccagagcgttgctcccgagatccagtcttcagtcttcatttgccttatgtttctgtagtcctgatcactgggaaattgtttgttctgtaacctttactacctggaccctgcaactccccctggccgctgcccccagcttctcttccagcctcgtgtgactggcaccgtgccttctggttgtcacttttgactgactggtcaccctgtctccttgttggtcatcccttgatgacaaacctgggtgattctgcccttctgatatcgcttctatccctaactcttcaatccctgcttctcaagccatcgtcacaactccttaccgttcgctccacggggaccaagtttcccagcttcctttttgccttccctctaacgttcttttcgttgcctccagtgacattttttaataacactatgttatacccctgcttcagatctctcttcccaggaaagtcagactccctgctgaactcatgggattcttcctgatgcaggtccctcatatgctcaggctatctgtcattctgtctgtcccgtcagtgcttctctcagaatcgctttcaggcccttgtctcactgggcagagctgactgccagttactgcatgaccttgctgtgacttcctggtgctttgggtagtgtttctatcatgtcacagcacctctccaggtgtccccagattccattcctgaaggtttggaacacatcttcattgctttgctgtttgtgtttggagcgctaatgcccagtaactattcagtggtggatatgctgatgagaaattggttgtgatgaagccttctcttctagctgggcaagtggcagctgctccctggcgagcctcactgcacttgtttctcacttggagccctctctgtgttcctttattttattgtctgtcttacattatgtctctccagttaattttctaatatttgtagagggttatagcctactttttattttcatagtcttttatagctgttcaatacatatcacctccctaaaccatacaccacacacacacacacacacacaaacacacacgaacatacacacacacacgtacagacacatacacacacatgaacacacacatacacacacacacacacacaccaccaccaccaccaccacacacacacacacacacacaccaacaccaccacaaccagacacacccacacacacacacacacacacacacacacacactggctggtgatacaaatctgtaatcccaactgctcaggaggctgagtccagaggaccacaagttcaagggaaacctgagctaaggagcaagctcaaggctggtctggtgaacttagtgaaagcaggtcttaagcttaaaagtaaaaggagagctgggcctgtagctcagtagtaagcatgtgtgtagcatttccgaggccatggcttcaatctaaagaaaaagaaaacaaaagtcacacagaactgttgaagaaacaccattaattcaagtctgtgcatgaaaatccccttgttgcttaaggaaacctgactctgtaggttctgctgcttaggtctctgatttagggacctcatgatgtcatcagaatgtccctagatgtcagctgtatgccgtggctttaagaggtctagatcagacctgctgaatctacctctcccctttagtgactcagatgtgtccccactatgttagttactatttgttgctgggataaagcaccacgacaaagcagctcatagaaggaaaaacttgctttgcttatggctcccaagggtcagttcacaataattagagaggcctggcagcaggtggctggagcaggagggggagaggtcacatctccgtccacacaaaggaagcagagagaggaacctggcagtgtggtggggctggagaccctcaaagtccctcgacctcattgacatactctctctagaaaggcttcaaattctaaaagttccataaccttaccaacagtgtcgctggctggggaccacgcgtgcaaacgcacacgctcatggggcattctcattctcaccactcactcccccagacttctccagttccacagggattttacatttttttttaaaaaagattcatgtgtatgttgagtgcccgaatgtatgtaagtgcaccacgtatgtgcagtgcctgtggaggccagaagaggaacttggatcccatgaagctggagttacagatggttgcgagattccatgtgcgtgctgacaactgaactcggggtcctctataagagcaacaaatgctcctaaccactgagccatccctccagccccgaatttaatattcttaatttcctttagtcactagtgtttcacttaacagtttgtggactgtctgagctgcccagcccccccccccccaggtattctagaccagagagaatccctggtccctttctacacaagtcacttcctgcgcccaatatgctccatcagatgcggggtggtggaggcagatagaagaaattacaacttcagacactaataataagagaaataaaagctaggcattatgggtcactccatacccagaggatgagccagaaggatcacttgaggctgccctgggctgttgagtaaggccttgttagaaatagaaataaaatataatatacaggctattgagtattacataacatgtggcaaatccctctgcttcacagcatctcatttttttaatcaataccatgtgcccggaatgagaagaccgtactcatcacaggggctgacagtgtcctcgagagggtgggtgtgagtggggccctgacagctttgtcctcacagagctgtggcattgccatgactttgcgactttcctactaacgttttacaccctcccttcccccttccagccagactgcgttacaaagattagagctcaagcatcagcttaattcgtgggaccataaaggtctgtggatgctgcatttatcctgcaagccatcagaaccagcttgactgtctcagtgtcgttgccatggttacagtggggctttctttttcttttcttttcttttttcttttttcttttttttttggcctgctcctgtagagttgctagctctctgcttaggagcatcccctaacagacatgaagctgatgcttgaaggctgtgtaaaactcactgtgtgtagatgctgcacgtgtaacctagactttagagttctgtctagggtagggcctggctccgctccggccattcctgtaggaaaacatgtgcacagctgtcagaccccaccaacctgcctctttagattttatttgggggtgtggctggttccacttgctcaggggtgtctcctctggactgcatcccctcctccatctcctgtcaagtcttacgaatccttccataaagttaccaagcacacggtgacgagtaaccgcagctcagtatttccctctccgggaaggtacctcttgccacgcttttggtcttaaatcctccctgaatcattaatgataaactggagtttgttttcagtcaattttccctaaactacacgtagagcatcattgcttaagaagtagctaagcaacttaaaacctatttaccagtgggtgcccgtgagtgaagttgttatggtaacgcatcctaaattaaatgtactatcaagaaaaataactttgtcacctaacagggagcccttatttgtccggggtagtcataagtgagtgatcatgtttcactttggattacaaactcatgtgggtaggagtcttgccatttttttctttttgttttgtctgtagcaaaaatataggaccctacacatagtaggctttcaataaatgtgtgttgaatcaatgcacagctttagatgacaacttactagactcataattaaaacatacattcaggaggatatatcaaatagaatataaaaggttagaatttagtgggaggtgctaagtaaaactggctgttattaatataatgacatgtgctattagtgtgtattaagtggaatgagacactgacagcctgtccatttgtagaataaataaaaggtagcacactgtgctttttatctgtcaggcacgtgtttatttcagagtaaaccactatttctcttgcctcagggattgatactttaaactatgctttctctgcagtattctttctaccagcagttgcatgaacaaaagaagtcagaaaaattcttcaaagtcctttatgaccggatgaaggccgctcagaaagagatcagatccacggtgactgtcaacaccatagacttagggagcaagaagagagacgatgacaatgacctcgtggcctcaggccctcggatgagaggtgaggagcttcctgaatacctgggagaagaaagcaaggaagcatttaaatctcatgtagctttgtcatcttgcttctggggtttaattattcccagtgtttccagtgtggacttccagcggtaaaggattttggttaagggcttgaccctagactagctctgcaggaccaaactaaaatggagtttaattggtgtggaagcaatgggcaacatgaaagacgtttgatttccttgttctgttcagtaagaaaaccatcccaaactttctgggaatggaaattaaactctgaggacagaaagtgtttgcgtttgatataaccagatgattgccagctaaatacaatttgtggaggtgttaatattttgcaaatgatcattctctcctatgagatctataggaattcttaggtgtgtgcacacacatgtgtttctttatacattcttgttctttctgtgtgtgccacatgtgtgtatgggtgtccacagagaccagaagagggtgtgggatcctagaaactggatctatagaaggctaggagcagcctgacatgggtgctgggaactgaacccagtcctctggtcgagcagcaagggctcttacctgctaagctatctgtccttttttttgttgttgttgttttgtttttgttttttgttttaacttgacacatagctagacataactgggaagaggggatactttccttccttccttccttccttccttccttccttccttccttcctttggaggggggggtttcaagacagggtttctctgtgtagctttggagctatcatgacactcgctctagagaccaggctggcgttggactcacagagatccgcctgcctctgcctcacgagtgctgggattaaaggcatgtgccaccaatgccctgcagaagagggaatcttaattgaggaaatgcctccataagaatgacctgtaggggagtctgtggggcattttctggattaatggttgatgttggagggatcagcccactgtggatagtgccttcctgggttctgggttctataataaagcaggctgagcaaaccagtaagcactccatgacctctgcttcagttcctgtgtgtgtgtgtgtgtgtgtgtgtgtgtgaaatcttgtgatatatctatcacaatatgaaataaaccctttcctccccagcttgcttttggtcagggtgtttaagcacagccatagaaaagcaactaacacaccacctgtccagccctttggttatgtccttgtgaagtcatctgtatgtgtttttacacattcttatgtgtctttgtgatatagatttatgagtcagaaaattctaaaattgattaaatataaagagcttttcttcagattgctgtattaactttttagctgttgtgtcccccccaggaaaccgttaaacatcttgttagataattttaaaattcagctgtgggaaaatttggattcttattgtggggtagttaaaaaaaattagttcaaaatccagctacttcttgcttttcagtgagagatccatcacttcacctgaaagagggaatgaagggacagctaacagaggcctcctcagccacctccaaagcctactgtgtgtacagacgagagatggacccagagatagacatgatgtgcccaggcccagaagcggggagtgcagaggaaaagtctgccgaggaaattaccatgagcccagccatcaccgtcatgcagcccatcctcaggttcctgcagttactgtgtgagaatcacaaccgggagctacaggtgagtcctcttctctctgtgggtgagctctgtagcctgtgactgtgagtcatccaagggaatttaggagaggattctggagaaataatcaacaaagacaccagtgccctgttgaaatggtaaggaagaaaaaataagagtcaaaatgtttaggcattaaaaaacaagcaaatgtacacatcctatagcaccactgagccccttccctctcctctgcagtgtttgttcaggacggccatctttgtctgcagttcatggttttagactcgggtgtttacattgttcccaatccgtagttgttggcacaatattgaatatattttacgtttcattagaaacaaagtcatataaagcattactatgatagtgaaaattgctttgctaattaatgcagcccacatccataacatctccacccaccactgccatttcctctgtcagacggggtgggtggacgagggctgctccaggctttgactacctccctggcgttatgtgtatgcatgacgttgcccatggtgccatagcagaggcacacgaaaggagctatcttgactggcctgactgagggagattgagaatgctcacctgaagagcttccatttggcagactgcttccaagaaagacacagggccaccacgccagcccgctttgccatgctgcaagctagtgtagctggcaaatgatctttattaatgaattgcagagaactggctgagatttctgcagtaggttccgcctaggatctcctaccttgtaatgtcactaagcaatctggttctcagagcatctgtccacacagagagaggcagagtgaggagatgtgttcactgttgtctagaacgcagaggatccgaaaggcaagacaaagtgctgtccgtggcgatgagatgctctggaatgcatgaggagcgagcgtggctcatgtggaccagcctgccaccgcttaggtcaagcttctgcagtgtgtgctgcctgcttgctcagtgcaacctacgggccctgccaatgtgggtcacagacggcagagcagatgatgtcatatctgactgtgccactcacagaagctggttcagataatgtataaggctactttgatactaagaacaaatagttaaagcaaattcaaatagatatctgtaagtacattaaaatacaagatcccctctcttccccattctttctcttctttagcgtattccccaaagtgcactaataacactgttttcttccagaaaatcctatgtacaaacggtgatctttgcatgtaaacctaagtagtctcgactgtttaatttagtaacttcatgtactgccacactgcttatttcttggtggtgcccatccatacatatggaagtgcttcctaagatcccaaaaccatcacgctgccagggataaggccatggcgcctaacagacagtgagcagtgaggatcttttgtgtatatctacacagatttaggatcatccacacaagtgggactcttccctgagaagcctagtagggcttcatgtttcccataccacggcctgacggaccctgcacagcgaagacacggttgtcagggacggttcgtttggaagttagaccccctcccccagattttgttctccttttcctttctacttttcacactcccttccaccctctgtaggcttaaaatgatggcagtggagcagcgtttactatgacctgttctgaaggtgcttacactacaacctgagggcctctcttaagagaaacttaacttagcgtatcgatatttaaatattacttagttttcaaattagcttggaaaataatgagtctgtttttcaaattttatttatttattttacatcccaactgtggattcccctgcttcctcttctcccagtcccctccccccaacctccgctctgcctcctcccctctgaaaaacaaggagttttattatgacagtctcatccctatcgtttgcttagacatagtcacaccagtatgtcccctgattgctccccttttgtgttggtccccccactttccccaaggtgttccaatttcttgtgaagaccaattgaattccatactggcaagaatctttttgagtaacacacacacacacacacacacacacacacacacacacacacacacagagagagagagagagagagagagagagagagagagagagcatggccagcacccctttttctgtgttttgctttccgtctctcagttgcactttctttcatccccccccagaacttcttgaggaatcagaacaacaaaacaaactacaatcttgtgtgtgagacgctgcagtttctggactgcatttgtggaagcaccacaggcggcctgggcctgctggggctctacatcaatgagaagaatgtagcgttggtgaaccagaccctggagagcttgacggagtactgccagggcccgtgccatgaaaaccaggtaaccatgactgcagagcttcatgagacgtgagtcacggtgtgccaggctaggcatagagccagcgttgtgtaccttcgaagccttcctgctcactctgccaggcattgccacttctcttacaaaacatacaaaggtggaattgtagactagcaaatgttaggccacattttaaatttcatcatgaaagaagattcccgtgaaaatatttaagatgaaagacttatcaaaagaagggcaagattgtatttcctcccagtgttcagtttctctctgtagggaatctctccagatgtgtggaattaactcactgtggctttggctctactgcagtgtgggaggaatctaatacccatgttacacactcattgagctagtcaaatacccgtgtcacacaccaggtgagctagtctaatactcatgctacacgctcattgagctagactaataccagtgttacacactcaatgaactagtctaatacccatgttagacactcattgagctagactaatacccgtgttacacactcaatgaactagtctaatacccatgttacacacttggtgagctagtctaatacctgtgttacacaccaggtaagctagtctaatacccatgttacacgcttggcgagcatatcaagtgggtctcgctactgtccttcagtcagtggcttctgacccagagctcacctgactttgcagtgtctcagagtgctgccttcagcgagctgcagaaaaaaaagctgcagagtactttctgagcccctttgatgctatatatgcatgtgtgagagacccaatgttcacctccagctcccagagtaccttgctccacttgaaggacacgttatgggagaagacagaacatataagggaataaaggggatgatgtcattttgacagctttttagcatctatgaagcatcttggagcctccaacacaggcaaggtttagggcggagtctccatgtcaatcatttctagacataaactttaaagttgcgattgacactaaacatcagtggttggtgtagaaaggaaaagttcagcttttctattgtagattatatgactttcctcacacatactatgtctgtgtgtacacatatgtctgaacacacacacaatatgtatacatccatgggttcatatggtggaaacacgtcgatcatgtaaggttattacttccttctctgtaatgtgtttatgacactaaaaggattttcagatctttccccctaattttcaagattatattttagtttcctacaacaatgacaaagacatccttggctgctgattcaaagtcaatgcacagtacagaaattcagagtttggtcttgttgataaaattctctctattgtagaaaatgttacacacacacacacacacacacacacacacacacacacccacactagtttcccattttgtgaaaagtctgactgagcattccttactttgtggttaacaatgaaattaggttttgaaattccttaatgaaaccaagtaagttctcagtaaaaatgtataataaaataacaagtcctacctggataatcccccatgctctgaaaatgtgtggaaggtccatttggctggtgttcccatgagcagaagcctcaggacataatgtcagtgttggatgggaatagctttcctctgcacaaatgcccaggccaagctgtcctattggctggggctgtcctttcttgtgtgacgcactggggtgtcagtttctcaagctgctcatgtggcttagaagtcctcatgctgcttccatagaacgaagcttgaaatcctcacacagtggcttttcaccctcagagcacacacagcactctctgcgcgggtgtttttctactttgttcaaccacattccctccacaaatatgcaagtccaaggaccctgtgaactttcccaccacccaggacacgaagtcacatctgctccgagttttgtgaaattcatctacaatcccatttttcttgtcctcttatatttattgcaccttaaaattcacagttccagaatctcattttgcattagtgactgggggagttttaagttacccagtcctctttggaattctgcagttctttgtgtcaaagataagtgtctttcgcaatgtgttagtattttgtgcccagtaccagtcaattgatagaccccactcccccccaaaaaaactaatcaaaatgtccaacattgtctgtacctggtatttgaaagtttcaagtcttctgtgaccacgtctagtgctgtgtcaaaatagcatgccgttttacagatatctccttttctagacctgtatcgccactcacgagtcaaatggcattgacatcatcatcgccttgattctgaatgacatcaaccctcttggcaaatacagaatggacctggtgctacagctgaaggtagtgtgaccccaacattttccgtgtgcctctcctgcttggagtggattttaaatcttcaagtgattgtgcaaaacaccgtctcacccagactcttcaagtgatgattgtgcaaaacccttttcaacccaggaactgacaggagaggacagtgagcccaccaggcgctcactgagccagggaaagcatgattcacctgcaggccatagtcattgtgaggttctgtggtagagatgttgaggctgcccctcacctcttctcccctgttttaacttcctgtttttcattacaaacagaagtgaaaggtgttggagatgcactgtgacatgggctttctaatcttccctggcttgagaattccatctagtggtcacaattcactaacataaaggaatgttgcattttagtttaaggtctttcttccttcttactgtgttatattaggatctagctgcctcccaatgacagtgttagtcttgagcctggtgtatgcttccagaaaatcctacctatcaaaatttaggcatataagggcaatcaaatattttttgttcaaacgaaaagagataaatagatgaaaaccacaacaacgtacataaatcttacatgctaagaaataatactcaagttagataagttacttgaggccacattattgtgttgagtgtttacgatggtgtaaagcaaatgcagggactaaggaaatagcttggtaagcacagcactcaagtttgctcccccagaaaccatctggaaaagccaagtgtggggataggccttctaagcctagcgctgaagaggagcacctctggcctgacaacatagcccctaatcagtgagctgccggccattgagagaccctacctcacacggcaaggtagagggcatacttaagatatgactgaggctgtcctctggccttcacatgcacagcacatgcaaacaaaactcttcacatagttaaacataacttttttttttgtaaagttaagcctatccaacttgatagaaaattaggttgaactttgtgcaggtgagtggccgaggagaatctaaaatgctatttgtatgtgctgggttatatccaactccacttctgggaatagtgtgctgggttctatttgtgtttttaccgcttttatccattattgatgtttacaaagtggagtcagagacaggttgataaatggtagtttattgggggaaaaacactcacgaaagggagccagtgaccaggtttgcacctgagcaagatggatccagaaatgcttcccagtcagctcagccaggcgaaagagagccgcgtgcgagcctccctccttcttaaacccttgttgggcatggtcagcagtaactcttaatcagggtttctccctacaatccatactgtgtataagatctaaccccccccccccctcccctctctctctctcacacacacacacacacacacacacacacacacacacacacacacacacacacaccccgctgcccttcttgtgcctttgcttcggtttgtgagcatctagtgtgtgtgacaggcaacccaactggaagcactaaaaagagtttgtcattctctcttaaattcaactttagccataattcctgaagactcaacatccagaggcctcctcctttgcctctaaagttctttgtttgtttaaaggctgtattttaaaatctggcttgtcaatcacagggctctgtaagggagatggtgaatgactcataaacttaacacagcttatgggcatgcaggttacttataaaggcagatcttactttgaaaaattaaataatgatttaatgaatcaaaatactaggtgttctagttaaattactttaaagtggatcatttaatttttatttatttcagtagcacaatttattcaagcatacagcagtcagctacattaggctgcacctaaagcaacacatgtgtttgtttctcttgaaatactttaaatatggttttatacttaaggactaagatgagtgtactttttaaatctaaagattttgttttattattattgcctggtaagagaacacctgtaaggcagaattatatatgttggctagtttaggaaagttcatgagatgaggcactataaataattatttagtaacattgactcctggatctgatggcttaattatccataattttagtaatataccttcaataaaagataacgctatgaatatataccatatgacataatataatttaaatataatatcatacaaattacagttttaaatatgctttatatattcatttaatgtatggcttaatgaatttctcagatgcctgtctcgtccttcactttgtattttgttttcgtaactggtctgtgaatgcaaagtgctgcatttgctaagaggtgatgtctgtgttttgcttagaaacactccagcttccattggaaggaaaatcccgctaacaggagtatgtctgttgggtttttcagtatatccaggctcatgtacttccagatcggttcagatttcaggatgttatttgcaagatttctttctaatctcaccaagtacgaaatttgattgaaagcaccacactgccaatggtgttggggaactggatacattttaaagtcctttctcactggccctgcagagagtggctcatctgagaacaggccccaagatgctgaggtataacctcggaattctgacagctctgctcatgtgggactaaggacccgtcatccgctctaatccctaaaccatatttttttaaacatttgttttttggaacctagattataaaagtggattgtaggatttgaaaatatttgtaaaatacaaatatgggacagaaaaaaaaagtagaatccctctcgctgcactgaaatcctttgtggtggctgtggcattggtgtgacccgacgtcacccttattatcctcagaatcattagatatccctttaaaggtggcatctggaagttctgggagcattggacagaatgtaggaccaagtttaacaagagttaatttacacgatcttatcaattagtgctttatcctcctacaccaaacatggattcagctcaattatttcattctaaaaccatgagaactccgagtctcttagacatgtctttaacaccccacacataacacacacacacacacacacacacacacacacacacatacacacacacacactcgtacacacacatacatgcacacacatgcacacaacatacatacacacacatgtacacacatacatacacacatgtacacacatacacacacatacatacacacatgtacaacatacatacacactcacacacacatacacacacatacataaacatacactcacacacacatacacacatacatacacacatgtacacacacacatgcatacacatacatacatacagacacacagacacatcagacagagtaaggttttatctcaatgaggacagagcacttccagtggtgactctctggtacccgttcagcattgaaaattgcctcttactttgatatcttaagcaacagtgtttgaggtagtgtgtttaaaaacaaaattgtaacagctgaaacatacactgctttaattctatattaagagaatagtagacaatgtcactcagcatgtggtgaggtaaacgagctatcaggaaatgacctttatatttctaactcaggaacttacaacttttctcactggtggttcacaaatttatgtaaaatttcaatattagagtaacattattacttcatttaaaaagtggttgtactgaattctttatatgtataccatgtccataaaatatcactgattcctgtttctctgttgtgttaaagtgtcatcatagaaatccaatttaaaaaacattggaagaaaatatatttctatttaatgtagtatctagtcagtcttccatttaaaacacctgtaattttaaaatatccccccttgggagggcagtggtggcgcacacctttaatcccagcacttgggaggcagaggcaggtggatctgtgagtagaggccagcctggtctacagagtgaattccaggacagccaggactgttacacagggaaaccctgtctcagaaaaaaaaatccttataaaataacccccattttcatgacttgttgcttttattttgtattgataatgaataaaatattctattgtccgttagttagacaaaataaataagaagtttcaaatttcacctggttgagaaaacacaaagggtgccagtgagctaagttaacacagatgccagggattgttaatctgtggtgtggactttgcgcatgtactgaccctgtccttgtccccagaacaacgcctccaagcttttgctggctattatggagagcagacatgacagcgagaacgcagagaggattctcttcaacatgagacctagggagctggtaagaacacttgcccaggctgtctgttaggggcagcatctctcgctgctccagcagggctgtcaggagcaccatggcctaaattcagggagggtggtgaaggaccatgtgactcaggcttgtggactcaccaggttttattttagaattagttttctctttttatttatgtgtatgtgtgtccatgcatatgtatgtcacatgtgttctggtgcccttagaggctctaaaagtgtgtcagaacacctggagccaaagttacaggctgttgtacatgcctggacatgggtactgggaatggacttgggttcctctgcaagagcaggaagcacacttaaccctgagccattgctccagcctgattttgccagttttatcgactttaagcacttctctttgctaaatttccacacactacttaactatatacaaatgccttttgcaaaaaaagaaaagttatcttggcttaatgatttctgggtatagttgtctgtagtagtgggctcagccctatagagtcacaattgtggactggaagagtttttaaaaagcacactgcaccgacacttatggactcttaccctgttttctcccatcggtgcaatgattcacatgtttgcatcatgttgcatgtcataagccacctggagatgatttttgagtatgcaggagggtgcaaataggtgcgtggttttcatgcaagttgctccagtttatagtgttacttgagtatccccaggtcttggaatcctcaggaggtactgaagccgggtccccagaacacccaggaatgatggtttgtaaggaaggtctgaagactgtgtttaccacacccccgagttttgtttgtacatttccaaaaacacagataaattcgtttgcgtgttttgtgtatcattctcatgaatgaactgtcacagaacatctggcctcagagaaagagggagacacaatcaggactccacaagcacaagttaaaagctccatttcttttgccttctggcacacaaacaatgatgtcatccgggcatgcttcaaaagcaatgggttccagatacccgagagagcaggctcaagacatactgctcagtgtgcccgccctcccgccagtgacaaagtcctgtcatgtcagtgatgctgctggtgctgtggagactgcaagggaggctggtgccacactctctgggctcactggtgaagagtagagtggagatggagagagaagacattctttagttagagcctcgtctctccaggcagtagagtaagactaggaattgcactctggttaaggggcatatggctatgaatttatttgacagagcactgtgcactcactttgaaaagagtcccctctgccattttaacccttttctgtcatctccatgatccaccctcaagctgagttaggtgcctgccggagacctgtcatacaacagtgcacgcccttgggcagaggcactctccttgtccacgcaggttcttcagtgcccagcactggtgccagcaccctgtccccagctccctcttgagtgctcagtaaacagtggatatttctcagggttccagactctcttaaatcgtggagacttcagcgtgctagtgttcacagacagaagcagaagtgttggctataaacagggaacattgccacagtgtgattccatgttcacttaaatacgccgtaaacagggaacacagtgattccatgttcacttaaatagctgtggttttcaaaaaatattttaaaaattattttctgttggtagatattattagttcttattatggcgctttggcacaaataagttgagctagttggatttctcccactgtgataaagcagcatgaccaaaggcaacttggggaggaaagggcttatttggcttgcactgctggctaatgccctggctcacattcatttacacagcctcgggcagacctgcttagggatgttaccagccacagtgggccggggcctcccacatcaattccaatgaagaaaatgctctgtaggccaatcttagggaggcacattcccgattgaaactccctcaggtagctctgggctgtgtccagtcgacagtggaagccactacacttctttctttttggtccccgtcacgtggtctatcccgtctccccttcgccggttccccctttcaccctatatacctgccgattttatttcatgcgtactccattgccctgtctcagcactctcccttcccttctgtctctttctgtcttctcacagtgccctctacattcacacccgacagactggcacatgcacacagttcagtctagagtctgcagagaagagaaaaatgcagtatttgcttatttagagctgctttatttttggctgtcatgaagcttcccagttttaagttatagctcacaaacaatatgaagtgttgctgccaccttccagaccctttctcaagatttacttatttattatttattgctaggtggatgtgatgaagaacgcctataaccaaggactggagtgtgaccacggggacgaggaaggaggggatgacggggtttctcccaaggacgttggacacaacatctacattctggcccaccaggtaccacattcttatcagcaagtatcttgcttacctggtcatggtgtctcatgcagatgccttattattgtatttctaccttctggtgtccttatttattcagcacccaccctccttgctttcagtcagagaaaacagtaagttggcagaatgccccattgtgcaattcagggtccgctagggagccattgacaagaagaagaggcttgggagaaaacttctgtgcctggaagaagtaagcctctcacaccagagcctcgagagagggaagacaggcttctgaggaggcagggtgtgaagaggtgggttagcggtattctataacttagccagggctagcccagagagagctctgcgttcagtcatattgacaaacttttaatagaagtcattaggcttgcacctctcagtcctccccactggactcccggaatttataagttaagtcctaaatttcttcagagtggtgtttccgtttcattgctggtaagtattgataagcattgcttggtaagcccaattccacaaacatggttgattttgaacttgcatcatctaacacagacaggtttaaaatgtaaaattctaaatgtgcacacagtgacttgatttttgttgccaatggctccatcattttgagaggataaagttcaggctttgaaaatgtctcaagcctctcctgtctgttttcctacccatcttatctgttgatgaaatagatactgattgatggaggtcagattgtgaaggttgctctttggacatttcctgtgccctccaccttcagatgttcacctaatggacataaacttgaataatgttttttacatcttcaaggaaggaatccaggtctaagagccccaccacaggactgttgctcttttgtgatatagtcaatacctagacatatgcaagattttcatagtctgtccattcacagcgtgagggcagccgagttacagctgtggagacagaaaggcattttaggccttgaggaaccaaaagccaagccaagagacaagtagaaggaagtgagaaggcggagattcaggatgtgggaaagtcccatttcagagaaagaaaagtcaggcgacagagctgattcaagctaggggaaaaaaaagaagagtagaaaatgaacttgaatgtgaacagaaagaaataacccttaggctgagaattaaaattgcaagccatgccacaggaacacagtgacacagttagtgtgtctggggcagagggttgcctcggagtctgtaacaccttggtgcggggaggcagtgaaggttggggcagagcgagcagcattggtgttttctaagaggagtcgagcccacctgcacactcttcactggaagctggtcttcccctctcggcgaaggctgtccctcagcatgggcgagcagctgcatgcttcaggcctggccttgtacatacgccacgggacatgaaccccacagtcaggctaaaccaacacaattgcaggcgttggatccaaatcaacccccgtacccttgaagtctcgagacaccagcaggagagtggacagccaaacgttgaagtcaagactcacgtttagctcagcaccgttttagtaggttgagcataggagtagaaaatgcagatgctagaggtggccgtggagtgaaggaaggagaacacacagctagagcagaagcagagaaggcagactgagggcaggggaatgaagaccctgtgaggggcactgagtgtggtgcatttgagctgagaacaaatacgttcttagagagaaacaatgtgttcaaagacgaaagagcaggaattcaagccacccaggggtcaccaggggtcaaaaacaacttgctgagaggaagggggagagcagcagattcggaaatggctggggtcccgtagacggctcttaccaaacttcctccagacaagactttggaaaagcagaacagcagaacagcaaggatatgctgtgtagctgcaaaagggaagctaggcttccagagtgaaggaccaggctcagaaagggagcaagtgggctctggactgctggactcattggccttgtgatttatccaaacaggtccctcttagaatcagagatgctgtaggagcagactcgagactcacagaggcacagacatacagaacccttcagtggttctgctggtgtgtgtaactcgtcttgttcccttcagtgatacaaggtgtcattccctcgtcagcatgtgtggtttccttccggaattaattataccactcgttttccttgagatgttagcaattttcacccacattggtctcttttgactcttccatgtgtgggtcctatggctagctttcggctggagtgttatttggtttctcggccagctgtgttccttgtgaacctactgtgcaaacagcccctgcacagaggtacacatgaaatgcgtacaagatggccagctgttccctggaggggaccagtagctgtgcagtacggtgccagatccaggtctgaggtcacctgcggtgggagtgaggcactcaggcagctgatgaccttgcagattctgagtctgcccctgcacagcccagtcattcaagaaccgagctgcagctccctcctcctgactttactacaatcgtcctctgcgcagacagtttattttggtgcccgcagactttcagtttttgttgttagtgcttctcgtggcagggacaaggttctgcttttccaccgtgacatccctctgggcccttcctgtggtcagggttacaagaagccaacagtgcttcttgtaattgtcttgtctaatctacataaaactattaatacatcacgaagggaaatttcttcagctctgatttctgcggtgttgtgctgtgaatttccttgccactcagcagtgcttcctggctctgccctccccatctccaggtcgcctctgctccccatcccttctctgtcagggcttctcttgaagcagtcaccacccaccgtctggtacatttcccacccctccgtagaagctcgtcacgtgtgaagctacatcacctctttagctctatcaaacaattcatcttcttgtcgtctgagtctcttcttttgactctcacctgaagtcaaatgtttatggaaagggcagggcatctcggctcgtgcctttataatccctaatctcaggaggctgaggcaggaggactgctgtgagttccaggccagcctaggtgcttgcatgagacccccgtctgaaaacacaaaataacagaaagagatacaagaaataaatggataaatgttagaggctttgtgggcaagaagatgctttaaatagtaaatcaatggaaagtaacaacagtcactttaattcgttacatgaaaatcttctcaaaatgcaagctttaaactttttttcatgagcattttcctgaatcaatacatggcctttgaacatgtcattttaatgactgcataattagacatcatttgaatgttctgtaatttacttaatcactccatattgttaagtaattaggtttctaatatatttgatattacaaattatgctgtgattaacaccctcatacattaatctttgtccaccatgctgatggttttcctagggtaattttcaagaagtttaattactgggtcataggaactactctatacctcttgatatacattgcaaaattactttccacagtgcgtgatggttcttatgctgttgaaccctaaacttcatgtcattgcaagaaaattctttcctgaactgatagcgtctggaatatatctctcagtccacagactcctgttgactatgtctgtgtgtgagatgcaaatggagatctcatttgtagtcacttccttagagtgattgccaccttcctaacactgcaacactttgatacagttcctcttgttgtggtggcccccaatgatgaaactattttcattgctacttcataactgtaatttttgctacagttatgaattataatgtaaatatctggattttttgatgatcttggatgacctctgttaaagggtcatttgactccctgtacattctttggtcctttgatcatttgtatttctcctgtggattacttgaaggtgtatttatcttttatcagttctcctttgccttacagaattttaattgaggatcataaccattcatccatcatattgattgtatctattttccaattcattgacctttcagtgttttaatatcccctttgtccataaccttaaatcttttagacacttccctggggtttctttgagcacataatgagttcaacttttgtatttaatcatgtagttttctatcatcatacatggatgtttggggcttgtagcagtcttcctgcctcaagtttccagttgctctgatcgtgtgtgtgtgtgtgtgtgtgtgtgtgtgtgtgtgtgtgtgtgagcacctgcacgcacacgtgtgtgcatgtatgtgtgcatgtgtgtataccaccatgcccagctgaggtggtaggttctggttctaactcttctcagaaggcacattctgagttttgatcagggtctgtggtagccctgtgcaggaatgtagagaatggaagcttttggagaagctatgaaggccagagtctagatgaacctgagactcatgtgtgtgagtgacctggatcagggcaggcctgggctgtctgaccctcctctcgggagaaagaagctggtatgcacctccatcgggtcccagccccggtcggtgttctactccttccagcacttcaaaagaagcctgaagtttgaatttttctaaaatcatgaaatctaatctttaaaagttggcaacttatttaaaaaatgtaaagtcacggagcaggccaacctagctggaattaggttaccacgggtagaacctaggatacacattcctgcttgagttgtgtagatggagtgaagctgtctggcttccaggcaccttgacactctcacaatgcagtaacagcgacaggtgagcattgggacaatttgcacgctgactaggaacagtggaggagagacaaacacggggcaattagcagaccatggtagcagccatgcactgatgggaatagggtgtggtaaagctggagatgagaccatctggagggctttctctgaggatttgaaactggagtggagtctaagggaaaaaacacaagtacatgaaatagagggtgacttacaaggcaccattcagtggcttctgaatggcaagagctcagtgtgtctacagggagaaaataagacctggctagctggtctaccccatctagctactgacacttgagtattggtcccattcagttcattttgggttcgtttatcacaaagtagtgattattggtctcttcctaagtcaggcatcatgctagttgctgagatgaaaaggtaaatcaagaaactcccaagaaagcaaattctggaaggagagggggatgggaaacttccatgattaaagatgctgtgttgaaatggaaaaagtgcaggttgtttgcacttggcagtcaggagcgagggaagaggatggttgaggcagagagatctgcttcagtgagaaggcagcatagagtctagagaggggcattgtgctcaggactctgcacagggtctccatcctgtccacttagacctttatgtgacaaagactacagtaattggaaccacgtggacatcgctgaaatggaataaccagccataggcacttaaggaaggtcatgcacatgagagaagggttggagagtgaagaagtgactaggaaatgaaatgctctcgggcttgggacttggtagtttatgtgtaataattaaaatccaaatatagacgctttttctattatcattgttactgtgataattcctgtcatcagagtgcagcactaataccctctgacgctgacaagacaccctttctcttttctttcttattcccacatcagtatggctccttgcagcagtggatactcacagagagttctgaggaataactcgtcacagcaggcacatgtgttcacggtgtttttatggaacgtaagaactaagaataggcattgggcagtcagggatctcacttacccagtactgatggcttattttcattttatagaccactcttggccagtcttttcacatagctcagtgtagacagggcttggcactgtcttccctcttgctgagcagttttcttacttgtgccaatgataccacccttctcttgagccaatagttgtcatctcctgccattgcctcccctacctcctgcataaattgtacacaattgtcttttttttttctgtttttgcattgttgtattcctcatgttcacccaaaccacatttttacatttgtggtagatagtgatttgatgtgaagggttttgcacaggcttgtgtgtttgaagacttcatctccaggtagtgctactgtttgtaggaggttgtagaacctgtgggaagtgaggtctagctagagcaagtgcatctcttagagagtggactctggaattttataaccttccatacttgctgtcctgtctctgtttcttgatccatccagaagtgagcaagcagccttgtggtcctgctgctataactgcagctactccagccaccatgccttccccactgtgtggactgtacgctcaaaccatgcagcaaaataaatccttccttcagttgttacctatcaagtatttgattggccacaacactgaagcagagtagttaataaatgctgtgcacactagtagaattacttccggttattttctgcgtattaaattgtttacgcttgcctggttgtttgttcgtgtgcaattattcatgcatagtcaattgtttgtgctcattggcttctgcacacttgattcttcctgcatctttaattgcatctttaattaattgcttatacatattcagctgcgcacgttcaattgtttgtgtacatttaactgtttatgccttggatatttaataaataggaaactcacaaatatgggtagtcatgagttctctctctctctcttttaaagaaaatttcaaaaacaaagtaaaatgagaggaaaaaaaagcttggatatgttagatttaaatccttttaataagcacgaaatacctttcactgagcatctaagagtcttgggttacctctgaattcgtagttagcagaagcaataaaaatacacaaaagtagaagtgggataaaattggactctaattttgagccgggtggaaggactgtaaagccaagctcaggaggagcagttatgtttggcttactggccgcctttttgttaggtttctgtgccgtggttatcagagcactcacctgaagtccagcaacagagcagctgtggctaagtgcctggctcctcttctccctcacacccatgctgacttcagctatatccacaggattcaaagtctcctgggagctgatgcaggtctttaacctcagcaagtggggggggaatcgccctggagtccactgcccagccaccccagctgaactaaggagctccggactctgcaagagaagctgctcaaaatatgatgtggggagcagtggatgaagacccctgatgatggtctttggcttccacgtgtgcacatgtatgtgtgagcacattggatgcacgcacccatagggacatgtgcttataccctccattcacgaagtccgttaggagtgccggagatatcagagagttgtatgttgtcgttcccattccaaaaggaaaatgccagcattttggcagcatatttcagccacttggattgtcacttggtgctaaccaaggcactctggggaggggtggaggcagcagacgggtaggtgtggctttgctgcttctcgccctgggatacttggttatgccgatgttttctagatatctgatagtcttcattaagccacttgccccttaaaaaatccatttcattgctgcaattgctcgagctgtactcatttcaagggctacgcatataaaatattctaaataccctgaaatcagtggaagtgtgtatatcactcagactgcctcaagtgtgcccctggggacaggagcagctcacctcttcccagcccccgccttccgatgctaatgtgtagtaatcagcatggcttcatttactttatttgcagaagcggaaagaggggtttgtaattggatccgtaacttccatcactaatacctctgaagggtgttgactaacttaccattatcatcacttgtgggaagtggaaacacagctgtatttgtcagctcacagaagcacaagcagcctggtaacatgtcagcagaaacgtggtgtagccgctgccccccccccccgcccccgtgggttgttctgtcctctgtcagggctgcacagattttccgacttcaactttcatccataaaagcagtgtaggctcctgtgagctttgtctgcaggccaaagtgtctttagtcacggtggctcttctgatgggtttcattaccttttaaatcatgtattggcctaactaactggctaccagatattcgtgtttgtatacacctcgcctgcttgcaatggatttgaggttaagtgagagatgcctgtgcgtaattgaacttttaaaataagaactcagaagccctgggagggaagatgatctaaatgttcaatgagctgtcactgatacactttctgcttgccagtgctgggtggagctgtggctaacacagagttaaaaataatgtgctgtactgtttgttagtgagcgtcttttactggtgttggaaaggaatcgaagtgagagcatactctctgtttctcagtcctctgacaggatcgatatcacttcccagttgtaatcaagagtcagcaaacaggctggagagatggctcaggctgttgataacatgcttgctgaacaagtgcaaggaaccagttcagatcctagttgtcggggaaaaggggccggccaaggaaacacaccctgagcagaaccaaagaaacacactttggccctggaatcagagccagtgaaagaaatacaccctggccctaaaactacagccaaaggctaaaagggaccagagaaagaaacacacttaggccctgtgcagaaaactaaccaatctctgagtaggagatctagccatcctaagctcagggattgaaatctggccaatccctaccctggaaatctccctggaaaaactccacccctaagaatccctgtataaaccctgtgcctgttcagcttctggccatttgggctgctcagctgtcctctgccaccctggcagagggcagtcactctcctggattcttccctcccaataaatctcttgaatgaggtttgggtgagatgttcttttctaggagcagagacgaccttgggcggagtggagtgaagcagggttgtaacacttgtcattgcccggggaaaccttcccctggctaagcagagttgttacactctgctctccaggatctggagcccaactggccgaactgaccaggaaaccctctcctgccagagcagagctgacacatctggggaagcctttccctgaagcagggcagtaagctgctatgcttactgtgacctgtggtattccttggctcccgagtgccagaatacctttccatcagagctgtaacactcagtattctgtgactcccaagtgccagaattcatccctgtccatcccatccgatctgtcagaatgcttacaccagtccccacctaaaaagctgtaatcttagtgcagtaattagaatgagatgcccccataagtcttgggcatttgactacttggtccccagttgatggttattgagggggattaggagacccttggccttgctggagaaagtatgccactgggggcaggctttgaggtttcaaaagaccatctcaaattagctctctctgcgtcctgtttatggttcaagatatgaactcccctcttctgctctggctgcctgccactgcctcctgcaccccaccatcgtgaaccctaaccctctggaactgtgagccccaagtaaaccttcattctgcaacaatagaaaaattacagaatatgctgagcactgaggaggcagaaacaggaggggccccagagctgactcaggtttgaggcgtgattcttgactgtcactggtgcctagtactgtggtggaaactgtgacacctggggcttttaagtgagtgactactactgtccacaagtgctgcagatgactggggaggtcgtggggaggtgtgactagatctccgtggtggttatgggctgatacagtttagttgagcaataagaagagttcttatgtcacctgtttatgtacgagtgtgcatacgtgcaggagttgtggttcacacgagaggaggtgaagggacagctgtatgagtggattctctccttgtaccatgaggactctggggaccaaactcagatcatcaggtttgatggcgtcctgccttctgtgggcctcagaggcagatgtttttgtcaaacagaaagcgtgttcggaataagaataaaggatgatatttaccgggctgtgtgtggaaggtcagtctcctaggacctgagatggcaatgtgaaatgatgggagtgggtgggggagagtggggtggggggggggggggtgggtggggggggggtgggggcgtcttaattacttgtgaaggactagatagggaagaatccacacgaatagaatgctcgtctcaacgcaccacgcacacggttcactcttccccagcgtgcccagttcttactaacatgacctatagttaatggaacgataatggttttgtaaaacattaagcatcacaaaaaaccggtgcaggcatatgcttcagaaaatacccaccagccccaaagcatcatcaggtcaagtcttttcatggttactgttgtctgaatcctagtttatatcctggtgtcactcaacatctattcaaaggtaagtctgtgataaccgaacccaagagcacacttaattagtcaacgtataagtgaaggaaaacactttaatgtcagagcatcaggtgatattctttatgcatctgtgcatgtgtgcgtgactctgaaacatacagcaatatgctgcatatgtgtttatgtgtgtgcatgcatggatctgtctagagcagcgttctctgtgtgtctgtgtgtaggtgtacctgcctacactgtttgctgattatctgccttttgtaactcagatgtaaatgaagattgtttacgactacacagccgactttccatcccgaacactctctgtggacatgtgaagggtgagatgtcaggacagagtccagctgacattctttctgttgatagatccagtgatagaattttaaatgtctcaaaataagcttttttctgttataacagccaaagagagttgtatgggtattcgagccttattaattagccacaacttggctcaactctggtcttctgtgtctgttgatcagtttgggcttcagaattacttaaaggggcacagaaaggcaccaggtcattgcaatagaacaatactagatactggatggtaaactgttaagttaaagaaagcaacccttcagattaaaaaaaaaaaaaaatccctggatcatgtcacacccaagagactgactgaaattatgcagtatggaaaactgtggtaagcccctgggtaagatttttgttatcaatgaaagaggctccactttagagataattaaattgatgatttcaaggtatgtagttcgctcatctgtctgtatcatatacatacatacgtacgtacataaatacgtatgtgtaagtttttgacagctgtgtaaggcctgtaaaccactatgtgccactctgggggtgggggccttccagtgtcagccagtaaatgtctggctgtgaggcttgtgaggccatgctgacggctgcacacactgcactctgcaactccagtacagaagcagccgtggacacgtaaacaagccggtctgcttgtgtttaccaagtgagacttcattttatgaaacaggtggcagaacagattttacccaggagggttgtttgccaaagcctgctgtaaatggcttttataatcttcacggtttcccatgccccatatctgaaatagcctgctcataatgggctgggcctacacagtggctcagcaagaaagcctcttacccccagcctaatgacccgggttcaacccccaggactcactgatgttaggagagaaccaactctcacaggttatactgtgactaccatgctctgtgacacatgtgtcccagccccataaataaatacgtaagtataaagaatgagaaaaaatgggctattttttctcttttcatttttttttcatccttcaatttttattttttggctcaggctctcatgtggcctgatcttgcctgaacttgttatgtagtcaaagttggatttgaacctcttaaccttcttgccttcatctgtagagtcttgggattatagctgtgtgttgctatgcctggatgtatacatttataatttaaaaagtaaaatatgagtatgtgtttgtgagtgagcatgtgtgtctgagtgcctgagtatggcctacggagccagaggtatgtgaagttacaggcactcgtgagtccacccacataggggctagaaatagaactcaagtcttctggaagatccaatgtgctcataattgctaagccatctctccagtgcatagttctaaattttaattcactttgctttcttctttgttgttgctgttggtgctggggattgaacctaaggagtcagaggcatgcgaggcaagcggaatgccggtgcccttctctttgcgtgtaatcctgtaacaccacacacaagtagagacacacacgagtcacgcttttagtagaagggaaaggaaggcgttagaggtgagcttcctattactttgatgaagcatgaccataagcaactcgtggaggaaagtatttattttgcttacacgtccacaccacagtcttaccactcaggaaatcggtgtgggaactccaggcaggagctgaagcagaagtcatgcaggggcgctgctcactggcttgcgcctcctggtttgctcagcctctttcttctacaccccagaaccacccacagtgggctggcccctcccctagcactcactaattaagaaaatgcatcaaggaccaatctggtggagtcatttccccaactgagggtttggctccctctggtaccaacttgacataaaactagccaggacaaggaccttataatttcacagttgtgtgatttacacattatgtggacagtggactctgacactaaacgaggacccactaagtatataacagggcagacaggtgtgtgctacccattgggccaagaagatggatgagtccactgtgaaccagggatggcactgaatcaggcagagtagaagcaggaggtccaggctcagcacaaaccaaaggcattgggcaggccaaggccgtttctcgcttatgcctgacatgaacttgggaaacagtgcaaagcaaacgtggggtgctcaaatggagtcaactccaattcctggattctgtctgctgagacttgggttggatcttaggccatccagggtatttttatttaacgtgtatacaaaccagagtttgtttttttttaaacccttctctggatttctgcccctttcatcttccttctttcaatgcctgataggtcaaccacctggccacacaaggctcttcccagtctttctctctttgtgctttcctctcccgggcatcgccccctcccgactgctgcctgctttccctctgctccccccccccccccaccgcctcgtctcagaagcttcggaacttcatctccatttatcaagatatttacctgataacaaacaaacaaataagcagaagctcacagtgaaagaaataaaggaatcccatctctcacagcttctgctcgtgttctccttggccctgtagagcaacaagattccacagcgttggaagacggtcagagacatcaggtagcggagtgggccgcctcaggtctagagcacgtgctagtcttacttagggttttagactccttgccctttctggcttctcctccaggacctgacattttcatttcctgtaggcgggaagcctaaggaggaaaggaaactgacttgctctgaagtccccatcgccagctgatttactaactgggaatacgctagagaaagtgcaggtgacctggggcttggacagctcctagggaaagagctggctgttggccgacgatgtgatctgagcctggaggtggaaaagctgagtagaacagagcaaagggcttggttctaggctgtgggtgtttaggagccaatgggacacaggacaaaggaatatcagaagacggctctgtgcttcattcttggcaagagaaggtaggcttgagtgtcaaggttacagacatgcctatagatggtgtttgaaattgtggtggtgattagacttcctagcaaagcacctggaatgaagcaggtaaaaccaagactgaaaacccagagtgatttcaaatgccaaaggcgggctaaagggggggggggcaggaggaaaaggacccccgggggatggctgggaaggagaggtctgagacagtggggtacaaacaggggagctgtgaggctcagcaaggttggacaactggccctgaagtacctggtgaggaagtgcacacctggctttgacatgcagcattcctgtgacagggcaggcagtctgtgttgcaggctcattcccaaactggaccataatgagcaggggagctgaggggtttaaaatatccatgccaggattcctggagtctcttcataccggtgttcccttaggccagtggcattacctaaagacaaacagtaaagagttacgtagacacactcagagggtccagtgtgcaagagccgatctctgcccttgccaagggttgtctctgtgagtctccactctgtgtggtgctctgtatctctcatctatggcacatgctttggactcacaattgtgctaattaaatgggcttgggagttgcactgaggcctcccactcacatgtttgagataaagcaagaggagagaagcatggctgtccaggggctcgttagagcaggaaagagctcagactcgcctggggtccacatgctaagtgggtgcaacaagaggacccaaggtgagctgcaaaagggataaagaaaggtgtctgagtggctggctttcacagagcgccatttctgtgggctggctttccttgtccattcctcctcatcgacccctgtttttattgattctatcctccattcagaagccccccttagcttgctttccatcatagttgatcactcccacctgtttaacaaccagtttaggcacacacatccagagcatctccatggtttagggcgtgagtggggccgggcagccaggcccttcctggcttctcccctggacttgacattttcccatttcctgttcctgtaggcagtagacctgaggtactgaggaggaaggaaattcagtcttgtaattctcccccacctgtccctaggttactcagggcccctccctcagtgaatgtcatgtcctataagcaaaagactaggaagatacccatgttttcttgggcccacccacctccctggccagcccagccagcctcccatcagccctactaccctccagcagcctctgaactctgtttccactttagttcctttccagtccactctccctaaagaagtcaaatgccaccagcgacgccccgtactctggctaatggaggtatgcaccatctggctttggatacccatcatggttgtgctcaaagtacttggcatttgcaccaagtctcactggccgtcagtgagtctttgagattcatattaacgtgatgctctcggtagctccacctacagagaagaaagttggagtacaaaggagcgacagcttttgcccgtggtcatttgaccctgggtcttctcagagcctgtggtgctaactggactcttgacccacctctgtcccattgctcttcaaaaaccacttactccgggatctgaccacgtccttcacaactgtttggtccttgtcactgtggtctctggtggactgtagcctcaggctttgttcttcctgcttctgttcacatgtgcaccccaaactttccctgacacagtagccacagtgaaccccaacaaagagattatgtcatgcccaggctaaccctggtctcagcaccttctgacactcatttcttagcaaaagtcttgtttctgccccccctccctcccttctctccttctttccaagtgttttagagacagactaagtagcccagctggcctcaggctcatgtccatcctcctcctctcagcctcccaatgcagggatttcaagtgtatgttgtcacatgtggcttaaaaatcaaatatatgtagtcttgaaagccttgttgtgtgacctgggccccagtctgtgccttcggcagtttctgcctcactttctctgctcaggatacagagctgtgctctgaaaccacaaattgtagccatggtttgtgtcttttgagcttgctactgttctgttctgttacattttcaggaaaatgatccctgatgatttgattttaaatggcagcctctgttccacgctctcggctttcttctttcttggccccctgataggtccattgtcctgtgtgtttgtggggagttcctggaaggcagggtttttgtcttttcactctcagaccccatcagaggtaacttcgctcacaccagaggctaaccagagtgcagaagtgaggctggagaaccaggcacttagtccacagtcacctgcttttaaaggagatcttttgaaattggattagaataagaggaatttttacatttgcatatgaatagtttgtggatctgataatgttaaaactcacgttccatgtatggataatcaatgatctcattatgtcataacaaggaaatttatactacaggtaacatctttgtccaaagtacctgtgtgcgtgcattcaatatctgtatggttaaatgtcatcctcactggtgcatttttctaaatgagtttgtctaaattttctttcttcccctcctttctctcctgccggcctctgcttttgtttgcaagctgggaccctcaaccttcagaacggtcaggtgccttctggtaactgagtaagcgcctccactctctgaaactttctggcctctttccagttctgctagactgctgaggcctttccaagagctgagattcaccctgcccttgcttgctccattgccgggcaggggcttgttgcaacacagagttcatttgagcaataatctctttctttacaaaccactgcatgaacacaagctgacctttctagtagctgttccttagttaaacagagacagcggtggcctgatagtgctaatctgctgtagctcaggaatagaggagaaatattcacagggtgggagggagtgcccctctctcagtgcctccgacaccacccaggctttacatctggctaatctgtgcacttcacattgcttctgagcctgccagtggttttgtggagcactgtaggaatcgccactataatttcaagcctctaattaacacagctggcagtggctttgccaagactatgagcaactgactcagtcttccaggaggaggtctggtagataggagctgataggagctggagaggaatcctgggctcttcactgagcaagggagtttgcccagggtgtgtggagcaacagtagctgcatcctccagaagccctctgtggtgtgttgtttgccggtgtcacagcaaggcaatcggccttaaaaaggtcaagtgacttgaacgtgttctcgtgaaagatcggtgggaccagcatagtcactcatccagctgtcactctgcctgcacagttgtgattcatcaaaatctcagctccttctgaaggcggtgtctccacctcccggttccttgccctaaaggatgcacaaaaattgccaggagaatgagaacgcctttgacaagagaagcaggaattcattcttcctggtttctttaccatctcaagaaattactgcttgattctagaaataggaattaaaacacgttctaaatatttacatggattatgccaattcatcattttctaaagaggggcctgttggaaagttaaacatgtggatcattttaaagtagagctgtcaaataatgaaaagtaattgggctatctaatcatctgtcggccattgtccatcagtccatccagcaaatatgaaccgccgttgtctgctggacacacatttggataggtggggtagtaaatagtaagtaaaacagaagcaccacccttctagacgttctgcgtgagggagacactgacttaaaataaggatgatttcacactcctgatggtgaggagagatccctgtggtctgtgtatttggtcttaggtatttcccaagccatgtttgaagagccctgcaggaggaggcagagagctgtggtgggtgggaggacccacgtacttctttctggtgcttgcaggactttgtaacacaaactaataaatgacccagagactgatattggggttcagtcttcaagctgaagatcagggaagcaaagcagccaggccactagctctcacctctacctcaggctgaaagggctggtcctgtctccatgagctctcaccaagcctcagactgtaacttctcctcagcgtggctggagaacaaatgcctctctgagaccttgcttctgtcttacatacttccctaatgttgggatgaaaggtgtgagctataattctcttttagactgagtcactcttgtgtagttctacttggccttggactcatagagatccgtctacctcttaatcctgagtcctaggattaaaggtgtgtaccaccacctcctagcttctggctgttgggattaaagttgtgtgcctaacttctatggcttgtggctgactttgcttttctgaatcctcagtcaagctttaataaatcataaataatatatcactacaattccccttttttgtccaatacaaaaagaagtctacaactaacataagaaaaactatatacaaaaagtacaataaatatatacaatatatacagacaagttcatcaacaatgtctcagagaaaatatctagtccatttgcatttgacaattctgagaaactacttcattttctatcctaaattggcgagtccaaagtcttgtagctaatttactttctattctcatttgctttattaaaatactttaatgtgtctcaaagcatttacactttacacatctttagtgaatttcttttctaaatctggtaaacaatgaaaactataactatgctatccagtcttcagctccctcagagactgaagaaggaagtgatattaaccgaataaacaggaagtgtgatcaaatgactccccaaaactgtgagaaatgacagaaacagctggctgtctggacagtcacccaaggttcctctgcagcattgagacatccatctttggcctataggcctagcatctctcacagacatttctgtgaagcaggattttctgaaggagtggactgccttctcttggcaaggtttcgcactcacactttttggtgttttgtttgtccattttggacagcatactgtcagcagcagagacaaaggcacttttcttgcccagtgtcttacctttgccacaaagaaagtaaactccatgtgagcttcttcgatgcccagcatcttctctgaattatattgatgctgccaggagcagacacgtctcattgtcataaaaaaataacctatgttattaaaacattttaaatgtcatattctgtagatctctgaagtgtttgaagcccaccctatgtctgtctttgaaaacacactgaatgtgactacaagttcagttgtaataggtggctaattcctcacctacaggagtagctcaggtaatggggccctctcatatgtgagtctgaagaaaacacatcacttcctgtgtagaaagagggagacccagaagtcttaaagttacacctattaacccgtcgtcagtcacatcaaaaaagacgcaaagtggagggcacttgtctctttcatcagttccacagaagaaaagcggaaaccttaggtgcccctttaggaacccctgttaatgttacttgtgtttgggataagcccatctagtgtgaagaattagtttcttttcttgccttcttttagattatttttgaaagatactgagtataggaagatgccctacatactgtcttttctcagaggtttagtcattcagataatagtgacttatattcttaatcgatgcccctgacaattaaactttatgcccatgccttttattaaatctgtcttgacattttacctgcatgtataactgtgtgagggtgtcgggttcctggaactggagttacagacagtggtgagccactatgtgggtgctggaaattgaaccctgggacctcaggaagaggactgattataattccagcacttgggaggcagagaggcaggaggatctctgagttcaaggccagcctggtctacagagtgagttccaaacagccagggctacacagagatagcatgtcttgaaaacaaaacaaaacaaaaagtcctttaagaaaggaaagtttgttaatttttagttttctgtattttaaagtggatttgtgatgacgaatccaaattgtttctggtaatgatgtctaccgttaggacagaacttggcaaatgttagctggattgaagtcacatgatggtgtctcagtttctgaatcagaaggaggtgctgggatttgcgtttctagctcctgcccccttgcagacacattcttttaggaggggtgtgagcagctgtggagtggagaactgtttccctgtcatgacagctctggcgttttcctcagaaacacatcacagggagagcttacaaaaaatgcttttaagtactttgttctgttgggacattctttctctctctgtctctgtctctgtctctgtctctgtctctgtctctgtctctgtctctgtctctatatgtgtgtgtgtgtgtgtgtgtgtgtgtgtgtgttgtatatttgtggtgcatgtatatgtacagggtacgtgggtattgaatgtgtgggtagtacatgtgtgggtgcctgtatgtttgtgtgtgttacacatggtgtagatggaagttactgtcccccaccaggtcctgcagctgtttagtcccaaataaacacacagaggcttatattaattataactgtgtggtagatggctcaggcttattattggttagctctctcttaattattagcccacaactattaatctgtgtatctccacatgacgtcctaccttcctgataggtctcctcccatggccgctgtctcacagctcactccctgcatccatcttccacaccttctagtctggcagccccacctatacttcctgcctggctatatcctgcctgtccattggccaaaacagctttattcatcaaccaataagaaaagcatatattcacagcacacagaaggacatccccatcacatgtgatagtgtgtgttttgtatttggggaagtgtgtgtgtgtctcgaacgtgtgggtggtacatgtggaggtgcatgtgtgtaagggttggtatttgttttgcatcctaagctttttcttgttatcattaaaggtttttttttttttctaaaattgactttactgtaatttaagacagactctaatagtaggggtgtaaatcatctgaaatatcaagaattttcacctgtaataatcaactctgctcaattccttgttacttttgcatgtaatctttgtcttactttggtcaccactgttatggaaataattaacagatctctaagagccatagtggatttatttaaatattggttatataaaacaaaggatgtttttcaaactcttgtaaagaggctgtggagtagccaggcctggtggctcatgcctgtaatcgaaacattcttggagccagaaacaggtggattgccttgagctccaggctagcctgtgttgtacagtaagctccaggcaagcctttattacacagtaagttccgggccagcctaaactaggacgtgtgtgagtgagggagagagacagtgaagaatagtttgctaataggaggaagaagtattctgggctccctcccccaaaccccttgtggttaatggcaaaggtaaatgtttccttgattcccgtgtcttgagaggatgaattgatcaatgcagagacagacgatttaagcagaagtttacttagcacagcaaaggacagcacattccagaaagaggagggaagggttgggaagggatggccagaagggtgtgttgaagtttcccttccctctcttttagggtacttcttcacatagcccttttgagaggcccaggggacataaacccaccgtgtaggtgactctgctgtgaagtctggctctttgatgatgcaaaccttttcttcgtgcacatgtgtggtgtttgggaaagtgccctggcgtttaggtttctattatagctagaagagcctgcagcttcaaggatgtttgaccacaaggggatttctgaccttccggagaggaccaccaagatgcagctgcgtttccttggttacctcagcattggttccttgcccaccgcatctcaaagggaccaatttcttatttcactgtagaagggtgatgtgtgtgtgtgtgtgtgtgtgtgtgtgtgtgtgtgtgtgtgcacgcaggtgtgatgaaatgccaccctgagatgtcatactttactttggggctcttgtcttttggcctggaggtctgtgtgtcctccacagatgtctttcagggtgtccagtcctagtctgtcaaactctagttctcagaaacgtcactctcatttttttctaatgccaacctttttgttaaccctgctttctttgagttctcaagagcttattttggatgtaaaagaaaatactgttcctccctctttctgatccagttttggtctaaaatatgttctaggcgatatgggcgccggtttgggactagatagcaaggacggttgggaaagagaagaactttgtaacagccactgagcggttggtgaggcgcgaggctccacccacctctgcgttactcctcctgcccccctcttcttccctcactcacctctgacgttctcacccccccttcgggcaactctgccgttttcttcttgagggaagaacccttcctcatggtagtctccgtgtcctgtccgacctcagagcatgctgggagcttttggccgggttttgcaggcaaggttttgtatttccttgaacctgttccgtcctccgctgttgtttcttcagatgggaatgctgctgggtgtaaatgcaccgttcacttattgacctaaacacaaaggcagtcatgtgacttggggatcttcaaacggggaaaaccaactccctgtcagttttaccaattaataatagttgaacatacactgaaaaaaaaaaccttagatagaagtatcaaggtataattaccatagaacagcattctggcacagtcgctggcttttcttgttattgtccagtccttacttggggccatattaaatcaacattgaaatcctagtgatagggagatagatatgaacaagcattttttcaagctgtattcattgttagtggagtttgggactttgtggtcggtcttcatttcccagttttttattttaaaaatatatgatggtgtataagacactgttggtgattatgtatgtttgtgtataaggtttgtgttatacatataggtgcattttatgatatacatacatatacatttagtgttacatttacagtttttactttaaaatttttatgtgtggatattgtgctggctctggtacctgtgcacccagtgcacgcagttcttgaagtggccagcagagggtgctgcatgtcctaggactggagttacaggtggttgtgagctgcccggtgggtgctgggaaccgagcctagaaatagactataatggattaagggttgtgaagagtcaagtaaagggagagagtggtctgactcacagaaggaaacagagtggaaggtgagggcagagaaatagctgattgattgatgtgacgttacttaaggctcatttttggttcggactgaaacttagagaactttattgttaatgctgactggcaccagctctggagagaacttgtcccgtgagctctctggtgacctgttggactacttaaataggcttggtgacttggaacttctgtgtggtgtggttaaacctgctctgttggtgccagggaagagcctatcccaaggcaatggcctctgtgtctttatttttgcattcctgctccttggttgttgttgcaggcctgacctctaccaagagctttgacaaactgatgctacaacctgtttcttggtctcctttatggtgacactgtggtgatatattgtgtatggtttattaaagcttgcctgaggattcagaaagcaaagacagccacgagccatagaagccaggaacacacctttaacccccagccagaagctaggaggtggtagcacacacctttaatcctgggactcaggtagacagatctctgagttcaaggctacccagggatacaagagattgaatcagtgtaaaagagtaacagatcacacgcctttaatcccagcactagaagggtataaaagatagaagcagggacttcagtggtcagcaggaggcatttagtctccagccatgctgaggagaggttacagtctgaggcttggtgacagctctgaaaacaggatcagccctttcagcctgaggtagaggttagaagctagtggccagctgctttgcttttctcatcttctgctagacgtttgaacccctctatcagtctctgggccatttattttttgtgttacatgacactagaagctctgggtttccaagttttgaccttcttcctcaatgtattgctgtgttgccaatagcactcagcgttcctaatcttccactcattcgttctggactcacactaagcagatcttcaatgccatgacataacagctgaggcgaacagcttatgaggagagaaggcttattttagtgcatggtttccaagttttgtggttgtggctttaatgcacaacattgtggccttgaagaggatgggagagatggtggtagaacagagccgtccaccacgccatctgggcagcagggcagaggaagaaaggagaggctgggaccaagggctcatcccaatgacctgactccctcctgtatgccccccccttaaggtcacctcaccttcccatggagtctccagccttcagcataagctgtgggaggactcctaagtttgaagccataacaggtccttacctcttcttcctcccattcctgatcccagtttgtaagtcatgtcagttctaccccctggaactgcccaattcttgccagttgttagtacgccccagtgattctaactttgaggaacacctacaagtcgcagcaagtttcatgactctggatggtcataaaaatctatataattcacatttagttgaatataaaatgtaagtaaaacaagacatcatgatcctaaaaggcaattctaaaaataatcatttcaaaaatgatttgttctggagtcagtggaatgaatatttaattgatcaaactgtcactttccagggtgttgacttgggttttataggtctggattattgcttgaatctgtattgattccttatggtcccatttatattaagacttcatggaaaacaggatgatatgtttacagccttgtaacaccaacaaaatactgactctggaactgaactgtctgaggtcagtactaattgcttttgccagtttctaactgtgtgattgtaggcaagttcacactccctgtgcctcagtttcttcatctgtaaaatggaagtgatgcaagtgtctactccaggatttctgagtaggatctaatgagatcttgtacctaaaagcttgcgggtgggagacagactccgccagggttagtgggttggtgtgacacagtgataccccctaggagtcccctggggaactcagggcagaaatagaacatttgcacttgagagctcaaggagattgcaaggtttcaggagttattcaagtcatctatgaaaaagatactccaagggaatgtgtattaattatctacaaagtgagagaaatacccaacaaatgccttcggtgttcagatgaaaaagatcacttccactggctgaccgaaagcagtttgcagtgacttacagacagggtggggaatgcttggctagagtgcgtgagaagcagagttcagacaccagtgctcacaatacactgggcacacagcacgtggctgccgtaatcctagttctcccacggataacaggctgcctacttggtgagctctacacttaccgagagaccctgtcttcacaaataagatggagaagaatgatagaggtccacctgatgttcacctttgacctccacacacatgcacacatatgtacacgagaagaaattatttatcattagattgttgggtttttaatgcccagtttcaaatacagtgtaatcgaaatctgtgcccataaagcgccagatttgacctggtcctgtgcagaagtacaggttaggaagaactgctattgtagggctgagctccacgaggtgagagagagccatctgggtagagagcccgctttatgtgtctacagcagcgtagcctttgtgttgtttctacagcccgctgccctgctggtcacagtaatttacatgcatgtgtaatttaaaggaatttcatcttcccaatgctgccgtcaacatttcttctctgcggtacaaccgcacatttgttatccagcaaatgtgagcactgattcctttttcttttttcaagacagggtttactctggctatcctggcactctctctgtagaccaggctggccttgaactcacagagatcttcctgcttctgcctcccaagtgctgggattaaaggcgtgcgccaccaccgcccagctgaatgaccgattcttatgcttctcaagtgtagccataaccttcctagaatgtggctaattactgccaacccaggactatgaaagacacacacacacacacacacacacacacacacacacacacacgaatggacagaggaacttcaaagtcttatcccaagagaagggtgcagagacgttaaccctttaattctttttcctgcagttggcccgacacaataaactgcttcagcagatgctcaaaccaggatctgatcccgaagaaggggacgaagccttgaagtattacgccaaccacactgcacagattgaggtacttactcgtgacttttagaaaaatctatttgcttactagctaaggccatttccatgatttttctcagaactgtgaaataatatttgatgatttaagtggaaaagactgtctcgcaggccgatgcctaagagtcacatgtggaaactgaatgtccatcttgcaaagtcttttctctccccagaactagtctgaagtatagatggagtgttttttgttcagcctggccccacagccatttagccccaaataaacacactgaggcttattttaattataaactgtttggctgatggctcaggcttcttactgattttctctctcttaattattaacccatttctgttaacctaagtatttccacgtgctcttggcttactggagaatgcccggcatcctatcttcccagtagctacatggcatctctctggtggcgtctctctgagtcctctctccagaattctcctcatctgatagttccacctatacttcctgcctggctactggccaatctgtgttttattcatcaaccaataagagaaacatatattaatagcatgcagaccggacattccccatggctgaagtttttgaaatggagactaaattttttttctctcgtttgggtcacagaagcagtcagggcagaccagtgacactttagagacaacataattactagagaatctgttccttaaaaattgtgggaacttcttatatggagatcatggtggcacctgtctttactcccagcacgtaggagacagaggcaggcagatctctgtgagctccagaccagtctgggttagaaaagtcaagggcagccagagctacacagagagaccttgcttaaaaaaaaaaaaaaaaaaaaaagcaaaataaaagtatacagaaaacaccggcagcactaatagaattttcatgttggtgtcacacactcaaggtagtcagctgtttacactttgattgtctgacagctaccctctccctgccccataaacgagtcatcatctactgtctggtggcagatcaggaggtgtcacttctagctgggttatcattttgatgcttctgggcagaactaatccgacagaagcaggtagaatggtggccaccttgtcattccaggttcaaaacagcgcatttactcattctggtagatgggttttagtttttagcaggatctatcaccagcaccgtttgctctatggtgggtgatttctatgtcttattgcttatttttgacaactctctgagcgttaataagcaatatcacttcatgccaaaggttgcccttctgctctgtgtgtgaacagcaacagagccacagcttgcatcagatttggctgctacactgacccatgtgttaatgagaacgatagcttggtgtgatcagtttaataactctgggaagtgggaagggttaggcctaatcaccgtccgagaaagaatcccccataatccaaacctcactgtcagcccctcccacgagtctctctgcttcagcagaaagcacgtccagttttaatcagtcagtcattggaaagatttcatgtatctgtgaagagctcacactagaccattgtagttatccaccactcccaatttcccagtgtttgctcccttcagggtgttaggggtgtgcgtgtgcgtgtgtgtgtgtgtgtgtgtgtgtgtgtgtgtgtgcgcgtgggtgtgtgtgtgcgtgcgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgggtgtgtgtgtgtgtgtgtgtgtgtttgcatgcttttgcatatgtgtgtggtcatgttcgtttgcacaggagaggcccaggctgatatcaagaatcatcctctgctattattcttccaccttactcactgaggcgggctctgccatctgaacccagagcctgctaacacggctcctcttctaaacagcttgctctgaggatcccctggctcttccttccatggctggaatgacagggcgctggcacacccagccaaggcttagtgggtctgtggagatctgagctctggccctcatattttcatggcaagtgcttttaaccagcaagctgtctcctcagcccttggggattatcttgttttcttcactttcagtaccatagtgctgctagctaatgactgagtgagcattcattaaataatcgggggaaaaattaaccatatttggctttcttcggttaatgcatttccttcagcagtttctctggtttgtcattgccctttgtaaaatgtgacaaccagaactaaacatgtcattttatgcagggactgaatattttggcttatctaatcaaagcttattttctttagtaagccctaagaatttcttttttaaaatacttgacactcttaactttcttttcacatggttgcctatcataccaaatatatctaagtagtttgtacaattgatattctaacctttttaagttagcatataaaggggctggagaggtgatccaggagttgagagctctggctgctgtggcagaggcctgtattctggtcccggcacccacggggcagctcacaactacccacacctccagttccaggatcaaaaccaacttagagaagggagattttatttttggcttaaggttccagaggaagagtccataagtcagggtaggcacagcactatggcaggggcgtgaagctgactggtcatattttattcctatgcaggagggtaatggaagagaaaacaagaatataaactctcaaatccacccccagtgacacacttctccagcacggctgcacctcctaaaggttccatggtctccccaaactgtgccaccaactggggagcaagagttcacacacataagcccatgagggacatttctcattcaaaacaccaaactgtaggtgggacaacactttaatgataaataaagatacctctctgtgtatagagaactcaggacacacaatgctaatatcatctgtttcccagagcccctcttaggaagaacaggacacaaatgcttacgtactaggttcaaggtcacccagctggtttacctttttcataattggattcataaaaatatcattcataaactcattgttctagtttcatgtctgttcccatgataaaaacagtcttgccaaaaccaacctggggaggaaaggatttctttggtttataactgcatgggagacattaccatggtaacctgagctagacactgtaaagaatgctggctcacctgggcttatgcttagctagtgttctgacacattccaggaccacaggcctggggatggcgctggcatggtgggcttgatcctcctatatcaatcaataataaagatgcccacagaccaaccagatcgaggggcttcctcaacagagcctccttccaaatgactcagagttgtgtcaagttgacagtgagaactaaggaaagcttggcacccagctgtacatccactaggtgaccccactcggcgcttctgggtagttcagaattggaagccacacggatggtcctagtcaaaatctatgggggcaaccaaccaaaaccaggaagtaaggagaacaggaaagagttctacagggaagaagcaggcctcggggaatgagggaatggcggtgatggtaactgaaatgtacgtattacatgcttgcatggacttgtcaaagaactaaacgtggcaatcaagaaaagggaagttaaaagtggagtccagggctgaggtgtgcaaatggctgaaaacaaatgaaactcgtttccagattgtgcggcacgacaggactatggagcagattgtcttccctgtccccaacatctgcgagttcctcacccgggaatccaagtaccgagtgttcaacaccacggagagagacgagcagggaagcaaggtgaatgacttcttccagcaaacagaggacctctacaacgagatgaaatggcagaagaagatcagaagtgagtctgaatgaagaggcgtgtttaacgtccccgagatcacttgcagggtggagcgtgtgcagaggcatgtttaatgtccccgagatcacttgcagggtggagcgtgtgcagaggcgtgtttaatgtccccgagatcacttgcagggtggagcgtgtcagccctcctgtcactgaagctgagcggtctgcagctcagtggacgcagaaatcccaggttaatgagatggcctgcagcttctgagcatgcttgttaatgtattatgaactgcaaggctgcagctgcattgttgcactgccggatggctgcaggtgtgaaatcctgcactgactccttgccctcaacactcagtgtatgtgtgggacaatatcctcatcagtgctctcacccagtgtcctacggtcagatagggctcccccccctggtttcccctcccctctcttcctctccatctgtaactctgtatgtgtttagacagggtctcacagctcagtgagtcctcaaattcactatgcagccatagatgactaagtacgtgatgttcctgcctccacctctcaagtattacttaagagtttttccaggagtcattctttcttctacctcccacccccatctaaatccaccaagcgaaacatttccaaacagctgtagtcagagagagtcaagtgatattgcagtcaaagccatcgccacgcagctctctctttgcaacctaacctgtaacataactctcctatgtatttgaaaacactgagtttgaatttttttttaattttaatttttaaatcattttcttgaggctgtggagatggcctagaagttaagagcatgtattgttctttcagaggacctgggttctattccttgcacctacgtggcagctcataattatccataactccagtttcagggttctggcatcctcttctagcctccagggcaccaagtgcacacatggtccacaaggcaacactcatatgcacataaaattaaagccttcatttgaaaaatctttttaagttgttttctaaaataacagaagttgaggaggggcggtcagtcctcttgagattagatcttcattgtctttggagactttcccagacaggtgggcatgtgtattatccattctccaccattcagttttctccgctctttactgagagagattaggagtatgaccagaactggtcagaggctctgttgggtataagataatgtcatgcagctttagttttctacaacactgtttctctttagaatcttgccacatagaactcagcaaaaaaagattggagcacctaatatatatgtggattattcaaaatttttatttgagatatttgaaaaaaataatttttcttcatgtaaaattaattgaatagcaagctcaaattaattcaaagttaatttagtaagaaactgggactctgttttatgacaagtattttttaataaaaaaataaaccttaaaataattcctagtggacattgtattttaaattctagaagcagagtatagaacaaaggtagaggcagaatctaaatgtttttgtgggctgatagaaacagaggaatgacagtggtgttgatgtctacaggccatgatctgttgcccagggggacagcattctgccacagcccctctcactgtggaacaccctctccaagacgagaaaaatgagctgatctcaggaggagacagtttgttagtcaatggcccagactggggtttgctctagatcccaaaagtggttttcattttatatgcctcatcccactgactctgacattttatcttgaaggttttaatcctaatttttaattatgtatatatgtatgtgccttttgtaggcttgtgcccacatgtgtctagtgcctgcaggagccagaagagggtgtcatagcccttgggtctgggttacaggcaattgttacctagttacaagttgaataatagacaagacccagaggagccgctaggtgcccagagtaggctgacagtttagctcctccaacacccccctcctgccctatatatttgctcagttatttagaagtggaaagaacagagtttctggcaagcactgtttagtagattcattcatcagctcatttctgatgacagacatgtattcccttttctagaaattcccgttttctttcaaactaatacccagccttctgcctcagctcctcagatgctgagacttcaagcctgagaaaccacgctggcttgagtaggttacatttctctagctcccatccatgctgtgctgcagcgatgagactcaggctttaaggtaactgactgagcatttccagtggggggaccatccaagtctgcagtcctggcttttatgacttcacaccataagaataagaccagtttacccatcagtattacttacagcacatatgtgcctgtgcccttcagtaaaaggtccccagaccaactagctgccttccccttaatctgcacgggccagatgcaaggggtttttactgcagaatcaccttcgctgacactcttgaaggacagaaaaggaaccaactaggaaatgcctttgccatctagagtctcacagtaagcttcctaagattagacacaatcacttcagatgcacgtctgtgactgttcacaggcacgttgcacacaccgttagcttagtggggctcccgtcgaccgcagcaataactgaccattctcacccttgtacttgttgcttcctagacaaccccgccctgttctggttctccaggcacatctccctctgggggagcgtctccttcaacctggctgtgttcatcaacctggctgtggctctcttctaccctttcggggatgatggcgatgaaggcaagtgcttgcatttctgcaaataatgactgcctgaaaattcccaaattacattcactaactctttgcagatttaaaataaagaagcttagtttgtgttaatttttttctgtatttattgcaagcacagagatattaagtagagtagacagaaaactgtggctggtagaaatgtccttatatagaaagctcatatgtagcatagctattagggctaagtattgaaaaatgaaatggcatgattgtgtttcaacctaattagtgttttataatgttttatctcagttatgtgagaatcttacatccaagcattttgatgagatagcaacaattacatcttactttctgtcttgtctaagggttttgattctataccagtgtgcatttataatattcataatcttagtcttttgaatacacagcataagacagactgtaatgatggacaaggaaggatgttgactattaaatcagtgttattaaattagtaatgcatgagcttttacaaaggcaaagaagggggaaattccatagaaaccaggtggggctttcagaaacattttgtttaggtttgacagattgctttggaaaaaaatctgttacaggtgtggggtacacttgggagagtagaatgggttggagacagagatgagagaaatcagcaaataataacctgagagcgtcctcagagcacatctgctcgtggggtgttaggttaatgagatgctgtcaacagagcacgtggaatgatgtcctgacagtttggcaaggagtagttgttacaaggtaaatattgtcactgccatcccaggggacacgggggagagggtgccataacagcaacagatatgtaagcaaatttcagatggacgggagtgaagagaagagattggagcccaagatcaacttcctgtttcccagtctctacatcaggtcccaccggtgtcaacgtctctgtcttggctgcaggttgagctgcataagtagagctgggggagcaagggggttacagaaagcacatcggagattggggatctcagacagtagagcatgtgtgtgactgcagagcaggaaataggcagcaggcatgtgtccgtctaccatgtcagcagaagcaaggcagcaaaaatgtcgtttgtgcaccacacaggtggaagtgggaacagccttctctcccctgggtctgggcttctctggtgatgagatcttgacacagaggggcacgactcttgagaggtaaagccccaccataaaatgataaattcatatcacctgcactcggaccactgaggatgcaggacagagttccaggaaagagaggcagggaatctttaagatggaagcatatctggaaatcatctaacaccatttgactgactacacaaggaaagcccaggggagcccttcagcctctaaatgaagcagacctaacaaatgcgaggctgcaaagcacagatctccaggctttgtggagcctggtgcctgcacacagatgcacgcatctctcttgaaaaggatttctgagtcagcagtaggagcaagatggatcctcagtcgtaggatgcgagtgtgtggctttttagaaggagggcaagcatgagaattgggggagcataggaccctgtcatgagcctgagttggatgattagtttgggtgaattatctcacaacaactttaggaataaggttaaagtctagattgaggttggcacaatcactatctcaagcttatcaaagacaaagattaggagctgttcaaactaaagacagagggatgaagtagatgacagtattgttcctggtgttgacattcatggttatcagtcatgcaatgtactgatatttgcatctagatgaagggtcttcatggcggtttttccattattcttgcagctattgcttaagtcttaaggaactttggtataaaatttaaaaaatagaaacaaggttctacgtattcctatagtatcatcatttggggcagggaaggcaatcatgaagccgtctggaaaatttgggccagagatggacctctgttaacacgggccacactttcccaccctgggccctactacaagcggcttgagagccacagagctgtcatggcaagggccagcagaggcatgggctggtcttcctccagttccaatgaatggtgaggtgtcacccaggctcttggaagtgtcttgagatcaactgtcttgttcacaggtgggttacaatgtcagtttagaaaatagtgtcctccattcacaatgatggcacaaagggatccaagggagatgttgcctctcagataaacactccaaggcaccatctccctccactgtagatggaaactccctcttaactgccaggaattatgtggaatctgttgatgctagggccatctccagccatgccaactgacccttcctagaagactagtcagtggagaactttttatcccaagatagaattatcaattttaaatctagagggaggatttttcttcacatattaagtgtaattcctcctcacaaacatttttgcttaggaaaataagattcttccaggtgatttcaatccactgggttccataagcatttatgggtaccattgtgtactacgcaccatgctaggctgagagatgctgagattagtaaagctgttttgtcctcaaggatctcatggtctggttaaggaccaagaaatgagaaaggcacaagagcaaggaccaccagtgggtttatagatagatgttgactttattggacctgggtgtaggaagaaggagtctaatgagcctgcacagaaagcccagacttggagaaggctgaggagtgagaagcagctgtgtttggcaggaggccatgaacaaatcagcccgaggcagggctccaagacaagtgtggaaatgaagtccaattttactgtctgaattttcttttatagaggaccagcttctaacatcttagaaagaataaattcctaaaaatatcttcccattaaatataataagacttattatggaaaattaatagaaatatgcaaaatattaagggaaagagtttccacttggtgggtaaggattggcactgctgcttggtattgctttggttttggttatttgtttgtttgagagacgagatctctctgagtcgcccaggttggcctagaattcactatgtagtgtaggccagccttgaactcacatcagtcttcagcttcctaagtgtttggatacaggcataagtcaccatactccactgagattggctttgaaaaatcttagcacctgtctttaggtgtgtcagagagatttatttttttccaaggcataaatcctcaggtcagaactaacctgatggttctcacagatggccacagaattcaaccttaattaactgcattaaatgactgttgatcttattttctcattccacacagatgtactcagtagcaagctgtgtgcaaggtcctgtgctagacagtccacaagttacttgtaaaaatggataaaacacccagttttaagtgcatagttttgcctttttgtatatcaaggggagaacccagcgggccgcaaacatctgggacagagtaaaggtgtggttagatcatctggcactggtgatagtttgcagaatgagcatttgtgccaaatcacagaatatcataccagactttatttatgagttagtctgacgagtcacatgataggaagaacactgtcaaatgttccctgaagatgtcaattttaatgcattcttaaaagaaaagctgggggatgctagagaaacatcttagcatgatttgctctgttgtctgagcagagtttgggtcttagcactcacatagggtggtacacaaatgcctatgactccagctccaagggatttaggatcctcttctggcctctgtgggcatctacacacatacatacacacacacacacacacacacacacacacacacacacacacacaccatgcacactctcacacacacgggcgctcgtgcacatacacagaacacacgttaaatagaataaaataatttttaaaagaagaaagccagggacttaggaaatggtttggccagcagagtgacagccacacaagcctgaagacctgactgtggatgtccagagcccatgtagaaagccaggtgcagctggggattaataaatatttagtggcttgctcagtatgaactccctgagcatattttgtctgcttgatagaccagtattatttactgctgcaagacacactgtggcaggataagactaccttgcacccttatagagtttgtgttttcatggagacctgagagtcaacacacatgtagtcggacattaaaggcactcaccctgtactgctctgggagagctgtcaaatcaaggcagatggtggctaggcttgcttttgctaggcagagcacatatataagccaatatcaaaaggaggctgtccattctgacaatgaggacggcgagctctttcttcccaatctttaaaaaatcgcttaaaatcttatttagttaacatgtgtgggtgttctgtctgcacatatgtccatgtaccgtgtacatagttggtgcctgtggagtccagaagagggtgttggatcccctaggactagagttgcagacagttgtgagccactattggattgttgggaattgaacccaggtcctctggaagagcagcaagtgctcttaatctctgagccagctctatggctccatcactgtttgtttggaagctgttatggcaacaaaagtgttgctacaataaaacacctgattctgggtgtttcataaggcaaacgtttatataattcccggttttggatgctggaagtccatgattgggtgtcatcatctgtccagtccaggtggggaccctccttggttccatcacaattttatggggaagctgcaagggatgtggctgtgtggagaaggggccaggcgagcaggggggctgcactttgcatcatgctctcccgggagtgtctggtgccgcccccccgcaaccccgacaatgccaatcccttctaaagacagagctctgtaatccggtttcctgctgcaggtaccacatctaaagactccattgccttagtcatatttcacaaggaccacgcttgaagtctggagcctctggggaaacagtcacagcacacaccgcacctaaaccacagtagagaacatgatgcagagccaggatccaagcacaggatctaaattagtgttttttttttttcatggattgtttgatggtagttgaaatgtttgacaaattacaaaaatctttgtaatgtttcaatgcattggcccccagtgaatacaacatttattaaaggatgtgtctgggtcacctcagggttttgatgcggatccaaagcttttctcatgaaagcactcaaggtgttttgtgtcagaagtcagttttagggtagaaagaagtggctgaaagaatgagcacccgtatggggttttggcccaggaggctggggagaaatctccagtttgttgttttcttcttgagtcctggtacccttcagtggaggcaataatgtggtgcccaaagttccttctgcagatgcagcacacgccacgcttgagaagggctgtcatcgattgtctcatccgtacacatgacagaattgcacttctttttcgagggaaaattttaaaacctcctttgtgagaaatttctaaggaacttgtttttttttaagtttatttaaaaatcattggagatttttcttatgcttctatgtgtgtgtgcatgagtgcatatatgtgtgtctgtgtacatgactgcatgtgtgtatagcttcatgtgtgtgcaagactgcattgtgcatgcatgtgtgtgtatgtgtgcatgactgcatgtgtgagtgtgcctgtgtgtgtatgtgcatgactacatgtgtgcatgtgtatgtgcatgactgcatgtgtgtatgtgtatatgtgcatgactgcatgtgtgtatgtgtatatgtgcatgactgcatgtgtgtgtgtgtgcatgactgcatgtgtgcatgtgtatatgtgcatgattgcatgtgtgtgcatgactgcatatgtatgttatatatgtgcacgactgcatatgtatgttgtgtatgtgcacatgcatgtgtgcatgcgtgtgtgtgcatgactgtgtgtgtgcatatgtatacatgcatgattgcatgaatatgtgtgtgtgcatgactgcacgtgtgcatgcatgtgcatgactgcatgtgtgcgtgcgtgtgcatgactgcatgtgtgcatgtgtgtgcaggcacacacgcatttttgtgcatgggtatgtgtatataggtgagtgtgtgcgtgtctgtggaaggcagaggtcaggacatcactcaccttgtattttgagacaaggtccctcaatggcctggaagtcacccatcccgctagactggccagcaagccccagggctctgcctgtcactgcagccttagcaccaccatccaaatgttaggcttaattcctgggggtctggagatcaaatccacatcctcatgctcatgaggcaagctcttccctggctggctatctgcccagctccatatttcctgatgattaaatattgttggaacttgagtcagtcttcaagtgtgtccattcatattcctacactcatatgaagactcaggtgttttaaaatataaaaatacatgtgcgtgtgttttaacacttaaagctttctcagatgtagtcacatgtgtgtgggttttaacacccaaagcatatctctatttcataaaatgtaaggttctataaactgggttcttttatttttgtttttttacatttgttatttattctgctgtctctttcctgtgtatgtgtctgtgtggaggtgagagttggctctcttcctctgctgtgtggtttctggggatcaaacccaagtcattgagcctggcagcaagaaccttcatctgctgagccatcttgctggcctgaactagattcttttgaggactccataatgggataatttgattctaatacaacaagggaatgatgaaggactatacctgatttcccacaatcatcaatcatcaatttgacttgaagttcccaagtgaagtacatttatcaaaagtatttcataaatcactcccgcaggagagaaagtagagttctcagactcgaagtgaagaatggtgactgctcttggactttcttgttgggacctccagctcctcaatgacactgaaacttactagtcaagaaagctttcctgtggtagaaagttgactgggttattctgagatttgtgcaccatggctttgtttgcatatgaagcacagaagccaaaactttggtgttttctatctgtgttttcttggtgacaagtaatccctgctcctttttccaggtacgctttccccgttgttctcggttctcctttggatagcagtagcgatctgcacatctatgctgtttttcttctccaagcctgtgggtatccggccatttcttgtgtctatcatgctcagatcaatatacaccatcggtctggggccaacactaatacttcttggtgctgctaatgtaagtacattgcttaactttgtatcttatggaattcagatgtattgagtgtaaatatggttaactatgcttttatttatgtgtatgcagtgaattctggtttgatataaatttatgttaactaaagtatcatttttacttgctttaatttagagagagagagagagagagagagagagagagaacaaaaagatgagtaacacattgataggtttaagtagcccttacagtgtgacccagttcggctgtccctttcatcaggtttaatgtcctcccagtaccatatctgccattactgaaaaaaatagcccagctactgttaacaactgaaagtgggttctaagtcatcccaaaagattgaattatgttcaatagaatttaagaaatacctcctatcaaatggcttgtttgggggagaaaagtgtgctaggcaaaaaatgaggtccaaaattgggctccttttatatgagaaaatcctataaacttataaaaggcctgggtgagattcttttcgccaaactttagtatattagaacaagaaaatgcttttgacaatgttagttttaagtgtggaatgaacaaactggaagtatcatgccaagaagcaaatgaaagatttgtagatgtaatttaaacaaaacaaacaaacaaacaaaaaacttgaatggactctgggccaatttcaggcaaggaatatctgtaaatggatatgaagaaaaggtaaatcatcaaactgatgaaataacaaatggtcagaaatcacataaatgctattgtagctacataattaattccgaaagcactgcctgtaactattgtcaggttcctaactcaatgttcagtactctggtgttatctcctatattaccttacatacttattaaggatagtgattgatcatgaaatcctgggacatcacagggagtctataaatattttggaataagtagctaatgagcaagtggatggatctgtggccactatgtattgaaaataaatgagctaaccaacttttaaagattgccaagatgagacaatatatagtcacttctatgttttcagtgtttctgaccttgattttattacaactcttcaatgttggacagcattccacagttcccagttgttagaatattaaaaaaaaaaaagaaaattttcagtttccatcagtgaagtaaagtgtgagcagaggcttttgaaagttaccagatgcccccttctctgggtttcttagggcttagatatcacattaatgcatgaacctggtccttgctcagccccatctccgtgttcctgtgtgatctggcccttgttctcccctgtctcaatggggcaatgcaattcattccttctggctcactccaccctgtctttgacatctgaacattcagaggcgattccatgatctgagttcgttttgtctttgctttgaaaataagctgacgttgtcaaatcatcaaccaaggtaattataggatcatcacaaagtgtataaacgtgtctatacctctgtgttgggctcattttgtgtctctagaaaacatgttcagcatgaaattgtattatttgaggaatcagatgttattcataaactgatcattgactaaatgagaaaaatccaagtttaagaaagtgaagaatagctaagcagagttgtcccccaaaataacaaacattctctgcacctgttatgtaatatgatgggcatttagagcaccaagaggtaggcaatgtgcagcttgccatctagaatttatgtgccactttctgtctctttctttctgtttccttttaaatttctggaccaagacgatgtagacagaggtaaggaaaacatttgaatgtttggggtgggcgtgaaccaaaaacatctggtgttcttttcctgtctcttgtaggacactataaagtgataacttccatgtgctttggtgaaaatcatctcaccataaaaaaaaatctctaccaaagccaagtttttttttttaactgcttcacgagaaagtattatgcatgtagacatgtctgtattgctaattccatgaattttccagtattccaatagcataaaacatgttactcaacaagacactaccaccagcctagggtcatctgactaaagaaaataatctatgtcgatttgaggcaaatttaatgaaattattataatttgatactacttcagatgttaatagaaaagtttatatttataatttaaagttgtgtttgctaccaaaagaataataaaattattttagtgaattactatatactttctcttcacataaattcgttacacaagtttcttagtttatctttactaatgggacaggaaaaataaagtaaaacatgaatcctatactaatgtaccttggtattaactacatattaataataatatgaattaatatgttaattaatttaatttgtacatagacatttgcattgtatagcaatgagaagctgtcattgctgaaataatagatatcagaaaaaccagaagaaaacattagcctgacagtttagccataacaagaggcaggatttgagacatcagatataaatcagccaatgtctgatttcatccttcttgtcagttggagtacggtatggacaactggtctaccctcatctggatgctgagatctgttgagaatcttggtatggaagatccagaaaagaacagtaactgttatattgatacactggtgataacatctaccatttaccaagtatcccctgtgcagatcattaatgaatcaatcagaaagtgttgccatatgatgtgtctgtgtcttagcgcatacagtaacttgtctgtagactctgtccttcataatgttaagcaaatatgaaaagtctcttttacaagaaaggaaatataatagaaggaatacctcagaatttatcagtttctagtttattatgctaaaatcgaattcgtttgtaaagtttgaagtttgtccacatttcaggtagattttcctgtcacagttgtctcagaaaactcagtaattttgagtgctgcaaagtatatcttacacagttttcttctcgtgcacagtgtggcctctttagctaatgttggtacaaattaacattctgaacaatacagaggcacattctataaatgcttaatgttgttcacatcactgaatatttttgcaaacctcatttatacagatgtagtatttcctgtttttaaggagattactgattcattagatggctgttatatcctcattaatcactccatttatctgtgtggcttagattatttgtagtaaagaaaagcatagtaaattatcagtaaagattttccttctgatgctaggaactgaaccccgagcctcacacatactaggcaagtactctaccactgagccacaccccaatccccacagtgaaataccttttaacattttctaaagagatctacttacactgttgtcttagttaggattttattgctgtgaagagacaccatgaccatggcagctcttataaaggaaaacatttaattgggggctggcttacagttcagaggtttagtccattatcatcatggcaggaagcctggtggcatgcagggagacatggggctgaagaagtagctgagagtgaatgtcacactagacctggcttgagcatttgagacctcaaagcaaacccccttagtgacatacctcccccaacaaagccacacctactccaacatggccactcctccatgccctgtgagcctgtgggggctatatctattcaaataaccgcactttacccccttctaataatggctggggacctgtgattcacttagtggtgctagcctttcttacggttattttaacgtgacacggtagagtgtgttctccccactttgcaagagggaaaagcaaataaggctttggtatcgagccagactattgacagttcccacaggctcagctgaatgaatggtgttctgagcggtgtgtgtgtagtttcatgggtgaccacatgacacgttagtctataggattgtgtcctgtcatacagtcactaaacacacaagttcagttcatgatctgaaactttcccttcatattatctctctctttcaaatacacacacggtgttttgtttaatatggtcaccgggtaccactatttctgcctttcagttgtaaaaaaccaaagcctctctgaggttgtgttgggtgtcataagtgatgctgctcacatcgtctgtgtttattatactgttctgctggcagtttcaaagattcccagggtggtatttgactgtgtgtaaatttttatttacatagtgaccttaagattttatcctgcctgaggtgtaacccacatacctggagatcattgaattaaatcatcttatgttttaccttccatcagcagactgtctgttgtttttccacttgacaatttattcttggaaaataggtcatgttttcccatagtaatagcacaaatgaggattacatattcttctcaggaagagagtcttgaataagaccaaaggaataacactatcgccaacacttagcagtggtcagtttctgtgaccatataaaataacaaaaagatgtcacaaaaattatggggccaggaggcgtctttaatggcttcagtctggggctggagataaggctcagtgttaagaacatttgctgtttttgtttttctgaagacccaggtcagctcccagcaccaaagtcagacagctcaaaaccatctcaaatggctcgtcctcacctgccccaaaaggtactgcacacacatgggtgacacacacattcatataaataaataacaagataaattctgagtaacgattaccttctaggcacatattatagacgtgaacaaagtcctctagaaacagagggatgtgtcaagaatgaagtcagtgacttctgtctttcacttcaccacatcactgaaagtcctgcaaagacatgtctaccacttgtgagcatacatgaagatatcacactgccgtgtgattcaccagggtgcaatcaatactcattcttcactagacactaactcataagcaaacattaatgtcacccttgctgtgacaaggggagctcttggtaaacaggttggttagcatgctgatttctgtgagacccagagaactgtgtggagctgtttctccacccttccttcttcactattactcaagtcatccaccaaagtgacactgtgggcaactttgaggaataaatagaaaaagtgaaacaaaatgtgtggtgctgttggcatctgtgctgctgtttcaggactgcttccagcagctcagaagagcagggccctgtagccacctcagcccaccatcacgcatcgcccacggggatgcttgccacagaactgattggctgcagcatcctcatgaggccgacatagaaagaccggctccatgtcaatgaagtcatgacacaagcaggaagaaggtgatctcggctctttattcctccaccaagtcccagctctcatggaaagtgccacacacaaaaaaaatttacaaatttcttcatgccacagaaactggactctcagttctttcctgccctttattcttgcattcatttgtccttggcataaactccttaaacacaaggaccgcttccgcctctgaactctgtgtgaacccatggcaaagccaccacacccgtcaactcattccacttccagatgtctctagaacaacagttctcagcctgagggtcacaacccctttgggggtcgactggccttttcacaggggtcacaatatcctgtatatcagatatttacatttgctcataacagtacagtagcaaaattatagctatgaagtagcaaggaaagtaattttatgtttgggggtccccacaacataaggaactgtattcaagtgttgcaacgttaggaaggttgagaaccactgccctagagaacagaagcatatgcaccccgttacatacaagtcaagggtcgtgcagcgccacccgggtaaacaagcaaagcaaatctctctttatttttcacgttaacatgaccgagccctgctcaggcagaaatgcatcttgtcttttacactttgtaaccaaaatttattgatcattttgagaattcagtttagtctgttcctccccagtatatctgcttcataaacagtttccctgtgtgttttttgtaactcatcgtagaaaatgaggaaatgacacagaaagcatatgtctgtgtcatacaattacccttgtgagggggtctttattctacttttgtataaatccctctctctatcacatcgatgaacctgggtgggcaagtccaggtaagttggtaagttttgtaattttggacagggtttctcaaaagcaattcagaataacggctggatgttgctttgccagacattcatctcacccttgttgtgcatccagcttgtggccagacacaggacctttgtgtgtattcattgcttgggttttgagcagttttctttcctgctcttagagagccactctgaagtctccgtcgtgtctcagtgctactgagtgacaacataaaccgcctaacagtgaaataaggctcctgcttgattgacagctgctgaagttgttgaaagtgggtggaaggtgtttgagattattactggttattgagagggtggacagctagttggggacatggaggagagagtctgcctttagtggctgtgttgttgttctgactagaccttcataacatgcaataattaccagtttttcattttatctgtatggattcagacttcaggatgtcggtggaaaagagtttgtattctctcaagtttgataacatgtatgtgtgtgtatatgtatgtaatacatgtgtgtgtatgatatacataatcagtgttgcaaagagcgtcctattttcctaaaggcatacatataaatacacagtcataagtatctaaggaacatttgaagagtcattgtagtaattgctctggccatgtcatgtcatctgggcttctgtgaggtaaaacctcctcacagcaggttttcagaaaccatcaaggcttcccatggaaagaactaggttgtccaagagtaaggaaaagccagatttacactcatccatgttggtgacagagctagggtctcattctctgtccctgtagctacagagtgagccagttctgtgttgttcacatgtgcattggcagactgcttgaaaaacaacccaggagggctctgagaacggaaaccacaacttaggaatactcctctttcggtgtcttgttctgcggatactgtgaagcactaaaatcccactttctcctccgtttagctatgtaataaaatcgtgttcctggtgagttttgtgggaaatcgaggcacattcacccgaggttatcgagcggtcatcctggacatggcctttctctaccatgtggcgtacgtcctggtttgcatgctcggcctctttgtccacgagttcttctacagcttcctggtgagtacagccatagggacaattgccgctgggcacgggatgcagcaccgtacaccttagactcccagttggtttcttttggtttggtttattgttgtttgttttatttatttgttttttagcagggcacaaattatgttatttttggtatttcctaggagaagtgtgtgtgtggggtcttttctctgggaagtacataggtgatggaattctattctttgctgagaagtaagaaacttccttgactcttctcttggcccaggctttgggttttcagccaagtaatatttccttaattcactgattatccagatgcaaagggacaaataaggatgtatatcttatctataatgtcaaagttacattagtcattacggtagtatgtaagcaaaatgagaaggaacaaaagccatcctagcaaaagagcaagctgtttaaagtatagattagcttaggtcatcatcattagtttatgatttagctcccattaccattgttagcttatgtcatctgggctaagcttatctatgtatatttaaatctttagacagttccccccccctgcccccggattccttttttttttttttttttttttgttctaagatgacttgcttcgctgtgtagcccaggctggcctctaactcacagtttcccacctcagcctctgtgctggggaggtgcctgtgtgcctacacacaactgtacatccttcttaaagatgcctctcattcttaaatgccattttcctttctctgtttacactgttttatagtcatgaatgggggaaaggagttggtgtaaaaacatggtaagcttgaatctgtgagcgatatttgagtgtgcacatataagtatgtggcagtgcaggcaaagtcagacctgcttgggagtcacccctcacccctcacccctcaccccacacccctcaccttgtttgaggcagagtttctcatttcatcattatgaatgccacctactctggcctctgatgagttaaaataaaacctcctttatgtgaaccagagtggtgaaaaagttgaagaaaccagaacattgacaatctagaggttgagtttgcattaattcatctttattgaagaatattgactttgtttctaacaatagctgtacttcccaagagataaaaagataacaaggtagtgatttttttttttttaagaatttgacacatcaaatgccagtgtcttaaagacaggttctgcatagcagtgattatcaaggctgtgattgattacagtggaaattaatggtgtaactctcgcacacagcagaccaggggattttcaaaggacacacacacctgacagattgttccaggccagctagattgtagttcttatccccagataagaacacaaaccccaagtctccaggtttgaagatcggattcatttccaaacatttttggacatttctgaaaatgaatataattttatttcttttaagtgcctctgtataataaaacatgcactcgctaattcataatttcagctttataatgcagcaatgtgtaaaacggttcccagcattggctgcaggcagcagacatgtgcttgagttctcaattcgtgtttagatttcctgctattaaagacagagtggatagtaacctgcaaatagagttcttaattggtctaaataataaaaagccagagtcagatatagagagaaatgctgagagatcacagagaaggaacaagccaccgccacaccttacctctttagcgtctcagaagaccagagagtgagttcctgtttctccctgcttatatcctgtttccatgcagctacctcacttcctgtctgtctgtacagacctccagacctctatggttagctagtggcaagctccactctctgactcccagacaggctttatttgttcaagtaagatatcaccacagtaaccctttagagggaaggaattgacaaaacagttacctttttttttgtggttctacttgcaaaaggataagctaacacagattttttatcctcatttatgtgttattttaataacgaagagtacctgcatttcccaaatattttaaattcaaacatttttctgtcaccaggctcacaaaattgttctcctcatttcgttttgagtccctcaattgaacgataaatttaatgactttttcaaatgtccataagccacatgtgcctgatattttaaatgccctaaattcaatggcggtgtgtcttagcaagcggtgtgacactgttgacgaagccagctgatgctcgtggatgctgctagagcctccttcattgaaactgtgcctccttgtgttctggatcaactgttggcgttcatttaaaaatgttgtttgtttgaaggctattttttaatttttgtctctgtagctctttgatttggtgtacagagaagagaccctgctgaacgtcatcaaaagcgtcactcgcaatggccgctccatcatcctgaccgcggtcttggctctcatcctggtctacctgttctccatcattggcttccttttcctgaaggatgacttcaccatggaagtggacagactgaaaataaaaacaccagtcccaggtagccactccaccctccaagctccccctaacagttctgacttgtacacaccttgtttgtgggatttcagacacactgaaataggtaaaaattttattttcacccttttaagatgtggtcttgtttaccagtgctgtggtttaagggtgaaatgtcctcctagccccgtgcgtttgaacatctggtccctatgtggtggcactgtttcagctggtggagcctctttggaggaagtggtgagccttgggttggacagtctggccttacttcctgtctgccctctgcctcctgacagctaacacagtgtgaccagctgccttggctgccgccaggtcgggctgtatctctttgaaccattagccaaaataaactgttcattccttcctcaatttgctcgctgttaggtatttgatcctagcaatgattaaagtaataatggaacttctaggagttgagaatttgcaatactgcagcctgtatgctgtcagtgtgggttgggaaatacacatctgcactccatcctacagggtttcctaatgctgaccatattgcaggaggcagcagcggcttcactgtggggaattcctaaattctttctttttgcctcttcttcccatttccccaaagaacagtatccagcacccgagagccaccactcagccattttccacatgcattgctttgtgtttaaaatgataaatgcgatttggaaaccattagggagggagaagtgtgttttggaagacgtgcttagaggctgtggctaaaagaccccactcctcggcgagtgactgctggggccccgcatgatgtttgccactggacacttggacatcacctcgtgttctcgctgagaagccccggcatgaggagctagcctattattttagacttcttatctactctgtttgctttctcacctctagtacacaccctttgctgggttaaattccttagttaacctttcccccaaccctgctttactctgtagaaaccacggttctgtgatgtgctgttttcttggttccactaactactgtttatagagacaggaaatccccaaaagacatgctttctcctcaaaccacagactttaaagcactttaattagtggagacatatgcaatatcctttcttgcctttaacagataattctttctaaattccatttatttatttatttatttatttatttatttaatagtctggaccagtttcccctccctcctcttctctcatcccctcccctatttcctctctcccacccactcctccccgtttctgttcagaaaggggcaggcctcccgtgggtatcgacaaagcatggcagatcaagttgccctaagacgaagcacctccccttgtgtttaggctgggcaaggcaacctggcatgaggtggaggggaaaaatgtgggaagagctgactagaaggtgcttttagaggtcaggtgagacccccacgggaaccccacacacccacaggggtgacagatagttcataactatggaattgacaatgcatagtaaggccttccataagcttatgggacgaggaaacggtgtttagatccattcatcagtgagtcccatgactcacacacgtgacagaaacaccggcttcaccggggacttcaactccacaccaaatatctgtctgcacgttcaggaccgtgggatgttttgttgttacttcaggtgcgttttctagagtttccacaggcattgccagcagctttccattcactgttgtaataataataataataataataataataataataataataataaaaaggccaaagaaaataatttcaacacaaggaaatgatttattttggcagcttttgttttcagttaatgtcacttaggcctatggcaagacagaactctgtggttaggcaaagattcttacccggtgttggctttgaggtggggggtggggtggggtgggggtggttctcaatatcgcttcaacggtgcatccccagtgaccccgccgtcactaggcctcccaaaagatcagataaactcctgagctggtgaccagacactcagtgtatagccctagacggacactgaagatgaagcccatcccagcagggttcaggtgtgtgaagaaggaaaggcctttctatcagtcccccagtgctccactctttctaaactgagatcagagagcctggagttataatcactggctagattagaggcctggccacagttcattcagtattgagaacacgtgagacagagacagaagaagcgctaaagcttccagaacaaacctacacggtaattactgttttctgagttctgtggtaaatattttctgttgtttggggaggaagttggtgctaatttatgaatgcactttctttagaaatagaaaaaaatacaacgtaagaaatgttaaagctgaaatttcaagctctgtctttactgaaaatgtgtaggagccagtctctctctctctctctctccttctctcccttccccccctctcactccctcacacacacacaaacttttgtaaatactatgaaagtgccgaatgtggagacaactacactaccttaagtctgctttccgttgccacaacagattacttaagacatggtagtttataaagaatagaggttcatttagttcatggttcctgctggaggaatctgcttgatgtctgaagaggctgtttttgtgaaagataacaacatagggtaccccaccacgaggagaggcagaccaggctttaaaatgaatccactatagagataaccagtaatccatggtgcgcgttaatccaaccccgaggagagagacgccatgtctcatcacctctcagtactttacagccaggttcagtttcagtgtgtgccttggcggaagtatctggcctacagcagggtctcagtgcatgtcgtctttattcttttcgttttgagcactgtcactcacaaagctgaccatgggtgaaatcattgaggctaacacactcaggtagtgagtgacattggatgcagttcttcaagcaggtgtgaagccatcagaaaccccacagatgggagcaagtggggagttggaaagtcagagcttgacgggcagggcctgggagtgctggggagggcggaagacacatgccttgcaggcatcattggagatttctgagaatgtggatgccacctctggccccaagatctgctgcttagtggataggaagcagccacacaggcctgggcagagcagtgccattgggaagtactaggaaggaaggtcctcctgacaagtagacggtgtttctcgtacctgcccactcctcattcgcatctacccagagtgcagaggttgcccttgtggctttataacctaaggcctccctccactgttccagccaaagctctgattctaaggatctgaaccatccgttgggtgcttggtggaaagttctgggctgggggtttgcatggctcagcctgctctgccctctgctcccctttgatattatagattgcaccttggtgacccctgggctccctgcttcatatctatgttcataagcccggggttccttcagggaaatccttccccaagtaggtacttctttcctgtctaggatccatctccctcctctctcctactctgctaatttgtgttaacctttcctttactcgtccatcagctcccgttacgcctctgcctcttgattcccgtcagttctccaaagcctggagtctgagccatgggagcccagtgtgacacgttgagtactgactgtcatcggggttcactcagaactccgtctccatgacactccttcccaaagctgtcacagcacccgtgtggccacctgggcctccccagcccacccactcttcacatctcctcccaatatcagctcccatttgtaaatctacttcttttggtcctctcagctatgagtcaaactttcaggttcaactttgcttcatacaagtgcaaagattattatctctgcaccatgtgggccagggaaaccagtgggaagccagcagaaagaggggttcctgggggctcggggaaggaaagttagttcccaaacatggttctgaaaaaaagtcttctatcctccggctatttgaagcctttattctctgagtcccttacctcattgtgaggactgcctacccaaggtccttgcttcagccacagggaccagtgacttgagcctgcattgggaggaagctgtcctagcagcccaagtcagaaccctgaatgcatgtggctagagaaatagcagtattcatggtggcttaggtcaacaatatcattagtactttatcacagcccctaaaagaaaacaattagatgattggagctttttgcacattggtgactaatctgtcctctgtaacattgctttaaaacaggcaaacaaacgtgtgctcagagctccaggctaactcaccaaaaggctttaggatgcagcgtggtcaaagcacaaatatctttaaactcggatgcctctgtggttgtctgtctgtcatataatacctgcctctctacagttctctgctctgtgttctcccaggtaatcacggggctcccaccatgaccctaccttccatgatggggacctgtcagaaggagaactgttcacccacgatcccctcttccgacgcaggtgtgtactgacaacccaggtctgtactagcccctctaaggagagtggatcttggcacttcataatgtgttgaaacagagaacaaaaggtaaaggaccgaaataatccaagctagagaaaggattccgcacttgttattctgagctgtcttggttctcacagtgtttctgcttacccaaacctggcagattcagcatgtggaaatgtgctgctcccaaacagcagcccacactaaaggatccgcttctggctacttggctgccaacaaggggtgtgggaaagcaggggttctactctagagacctggctgtaaacctggccttgccactttgctggcttacggtacacaggcttccagaaccatgtttggatagcttataaggacagaaaaatgaatgaacaaaatccctctccccctttcgggagcaagcagatgtctaaaaatagctttagctctaaaccattcccttaagatgtgacagcagtctgggaatatggcatgtatgatgttttataaattatagaaaaaatagtggtgtatttcataaagcagtaaacacgacggattgtgtgtgtgtgtgtgtgtgtgtgtgtgtaggtgagtgtgtgtgagaatgtgtgtgtgtgagtgagtgtgtgtgtgtgtgtgtgtgtgtgagaatgtttgtgtgtgtgtgtgagtgagagtgtgtgagtgagagtgtgtgtgtgagtgtgtgtgtaggtgagtgtgtgtgagtgtgtgtgtgagtgagagtgtgtgtgtgagtgtgtgtgtgagtgagagtgtgtgagtgagagtgtgtgtgtgtgtgagtgtgtgtgtaggtgagtgtgtgagtgtgtgtgtgagtgtgagtgtgtgtgtgtgtgtgtgagtgtgtgtggtgagcgcagggccacattcatgttatgcaagtgctctacccgggagccacccccaccccttgtggactctagatctttgtgtcactctggagctgtcatagctaaggaagcttggagtccattaaatggcaaaatgaactcagagcagatgaaggaagtgacatgaaagacagtggaaggaaggagcgtcaagttaccttgctttcttgagatgttggactgttggtgggagggcacagatggccccctccctgactaaatctccactttgtgacctagagagagaatcaagcgcttgtatttatcccaggcagtgtccaacagtgtgggcacttgagatgttcccagcaaggtttgcctgacccccagtcaaaactcacacaagagccaggtcttctcggcttacatggcatcaccaagtgtccactctctacagtcatattacgtgtgtctgttggtttaaacacctcctatttctcaggcttccccacagatctcagaggaggttctggacttcaaactcctactcaagctgctctcactgtgggtggcgagacctctctaagtcacatcatacatgctctttttaagatttctttttatttcttttaatggtatgtgtgtataagcacctacaggggccagagagtgtcacgcccccttgacctggagttacaggcagctgtgaactctctgccgagagtgagagtgtggtgggagacgactcagatcctctgcaacagcagtgtgtggccttaacccctgagctgtctctcaagctcatctcacgctattgacctggcttccaggtttcactgccctccctttccctaattcatgtgacctgacgtgccacttggccttgcatggctcttgacctaagaatggttctgccgtttctaacttattagagaaagatttaccatacaaaatgggcgtggcccagagaccctgagaagtttcatctggatcctcacagattaaaacagaatccaaccactgctctagatacttccacaggagatctaggaatgttacaaaggaatttcagggcctggaaacactctcagatgctttatgaaattcttcagctacctagaaatttgtcacaaatgggactgggtgggtgtctcaatcagtgaagtatttactgtataagtgagaggttatgagttggattcccaggacacatacacacactcacagacacacacagacacacacacacacacacacacacactcatagacacatactcacacacacacacacactcacagacacacacacacacacatatacacacagacacacactcacagacacactccaaacacacacagacatactccaaacacaaacagacacactccaaacacacacagacacacacatcacacacacatcacacacacagacacatacatacacacacacagataacacacatcacacacacacacacagataacacacacacacacacacagataacacacatcacacacacacacacacacacacacacacacacacacacctgggcattgcacttgtaatctcaaaactggggaggagaggacaggaggatccccagggctcaatggccagccagtctagctaggagcaattgagaaaggcaacaaaggttgacctctggctgccacattcatgggcatgtacatgcaccctatcagttaatttccctctctatctcacacacgcatgctcacacacacacacacacacacacacacacacacacccacacacacacagagagagagagagagagagagagagctcataaataaactatcattcaatttatgtactttctaagttttttttttaattctttgtgaaagccacaccccccccccggtcgtggggcacagtgcctgctcatccccagtataaggacggcttgtgccatccctgctccccccgacagcatcctgtcaaggacccacttgagcatcttctgttagcataaagtcacttgtcagcagttttcagagtctgtctccatcttaagtccctgactacagatgtctctccttttcctaaggacaaatagggactgttcttcacccctgtgcagtgctccccccccccagtctctgtcctttggggtacaacagagctggtagcagtgtgtgggaatcttgtagagaaagctgccacagtagaggagagggctggcagagctgttccggagctggggtgagggtagggcagctttcccggtgaaggttttctcacagccatacctagagacactgagaagccacagcagagccatcgtgcatttgacgttcaagtgttaaaattgatttgattagaatttgggaagtctatggatttgacttttatttttataattgaagttttaattttttacagtaggctgtcactatttagccctggagttatgaaaactcgatatgtagatcagactggccttgaactcaccgaaatccacctgcttctgcctcctgagtgctggaattaaaggcgtgtgccaccaacacccctagtggatttgacctatacattttgcctatgtggataatttcagtaattaaaatgtgtaggtcttatcttcagggccttatttgctctaacttttggcagaatgtgtgcagctacagttatttgattggcaagcctatgagtttgatcttctgtgcttctttaaatgatgtctctgtgtgtttagccacgtaagtagagagaaagctgaagtctggcatttgttgtgcaacacatgtcacttaggcttaaaaatagcttttccctgtctagggctggggtgcagttctaactcgtgagctgtggtgagcatttttgagggccttggtctgctctcttggggccagcaggtgcacatcacagaatacccaggcacacggcacctgtgtaaaagccaggcaatggctggcaggcacagttggccctgggaagactcctggagatgcagatttggtcatttttccatcagccgaggattcacctgacaacttgcaacaaattcaacttgaaaaacactccaaaatgtttgtatttcatttacttcaagcctgctagaacctcaggtgaaaatacctaaatccccaccaaaagtgacttttccagaaaagccaagctttgttaagacaatattaaaagtctaatcatggctactctgtgagtcaatgccatttgcacattcaggagaataaaaagttcacatgtgtttaagcatttaagagaccaattttaatctcctggtatcctcctttaatagaaatggttggtggatagcagagcttgtcaaggtaacacatgctacattttggattcccattgggtatcagtcttttaaaacattttcctaattacaaaaaaaatttaagaacagcatttctctaatgattggattagagtcactaaagtttaagacgagaggacttgagttgccatcagatttccaagtgaatctcagctccgggctgctgtgtccacaaacagcaagtaatttaactaataaagcataaaaaggggacatcaataaatacttacgttcgagcatgtccagtatttttaagatgtattttttatttatgtattttgtgtttgtgtgagtatatgccaagccagaagagggcattggatcccctggggctagagttacaggtgttgtgagccaccccacatgagtgataggaactgaactctggtcctctggaagaccagcaagttctcttaaccactgactttccccagccagtgttcaatgtttttataatatatagactaacattccaagtgaaataatgtcttcagaacctgggggataggtcttttattcctttcctcaaatgaaacttttaatcatcatggattaagaaaaatgtttttctgatggtcagcttaagacagatagataagctcacatcactcaagtgtcagatttgtttcttgtattaaaacaaggccttttcataagatgtaacagccactgtgtgtgggtaattgataacttgtatttactgagcccttatgatgtaccaagcactgtgtgtgtgtgtgtgtgtgtgtgcgcgcgcgcgcgcgcgcgcgcgcgcgtgcgcgcacatgcatgcacaggtatgcccctgccatcccattgtacctgagggaatgtctgctaggcccgactgtgctggccaggcccttcatttgatatttattcagaggccactgccttcaggacacctaggctgctgtgtgtttgctcatctgctgacccactgccttcctcttggggaccataaggttccagtaggctggggcacttatacctctgtctccttttcctcacacaaagcctgtgttgtgtacagataagcttgtctcacaagtgaccacaaggtggcacttccctatgggagccctgaatgacttattgagagtggagtcatgtcaaacagtagacccttttaataagctcatagaccccagtgtgcctgtgtttgtagctcctattgagcaagatgatgggccaatgctggcactgacataacttgggcatcctcctgctactcaatttttatatttcacaaacttacgcaaccctgccaagtcacaactctttgcttagttcttgtcaattgcataatcgtaggcttcattatgacacttccatattggtatttaacgaacttggagcatatttaatcccaattaccctttctcgggtcccatctccttccccccactttcacagtcctaatagttccctaccctttgggctttcatgtcttctaagttatacatatcagacaaaacacaattcttgtctttgtgagtctggttccatccattttcttacaaataacataatgctgttcctgtttatgaatgaacctgttatatatacaaaccacattttctttctctgccggtcccttcatctgtgatgtatacagaatgtttctgtcctttggcttgtccacaggtttctctgtgatgggctgtctttgagtctttggaatctgagccagaaatggcatagttgagtcatgcactggctcaagctttgattgtttgagggacttccatgctcatttccatgcattggcccacattcccacatgtccaccagctgtatgtaagggtcatattcctacacacacacacacacacacacacacacacacacgcccttactaacggttgttggattttttgtttcttgtttttgtgtttgttttgttttggaatcttgatggtagccctctgatatgggtgagaagggacctcagtgtcgttgtgatttgtatttctcttgtggcccgtcatggtggtgacattttgcgtatgcttcttggcagccagtgcattttatttatttcaccgtggctaatcacatggtgtgatgtgtggatttccctaactcctgagacagcttcattccctgccacttccacgtgcccaccgaactggcacacgtgggtcttcagccggcatctgctatgctacaaccaggcagttaccgattaacaagtgcatgtatccagtgtcccacgaaactcgttactcatttgctctgattgaaagcccttcttttgcaaagtggcagtagctgcatcctatgacctccttcctggaacccagagattctctgtaaccatttctttcactctcatgtctttcctttttctgtcaccaccacaaagctgtccccggtccccgttgctccttcctccctcaattccttcagatttccaaatcagaaatctggttcagctccatggtgagcgactacacacggtctgcctgtctccgatgctgggcttgtgtgtgcctgtctctgcatgcagccttccggccagcggtattccaccatgctttcaaaggagcaacctggactcgtgtaaaaatatcagggtctctcttccttaggatataaaataaaatctgttcagaagagagaagccagccttctcctaacgagagatccacggccctgaatcatgcagtgagaccacttgcctgccccacagcctgtggttgcttttacgttcttgccgtgacatgcagactgtagccccaagtccccaaggacagttaactttgtgacaaaatgagccttggcctttctgctcatttagtaatgtaacagaatcctggttctcatacccagctgagcagccatccttgctttaaatggttttatgttttctgtctggatctttcagcaaggggttaagtctcaggacgcttctgacacaatagatcatttctaagcaggatttcatctctagacccaggtggtccctcaaaaaactctcaaacttactccaaataaagacagaatgacagaattgtagctactgtaatcgaaagctcctactatgggcagttctaacacgccttacatggtccttggctaaccctccaactcacagccttctcctcgttctctatgaggctgctgagatcagtgacttgccccaatcccgatggcttccttggcctgacgccttcatctgcaactctttgcagcttgggaggtggagagctgtgttgaccacattctccactacagtcaggcgcatgagttttaaccttgtcacactttacctttctctcctgtcattccccaccaagcccagaaatgcaaaatctcaaggtattatatgtgtagctctacacatgtcagtcccgtgtggtcacgtgtgaagtagatgtcatgtgacttccaaagattgtgtttgcacagtagaagcagactcttgggtgtggatgacagtgtgttctcaaagctctcttgtgtctctgcagctgacgaagggagtgatgatggaatcgagaggacgggataatctctgggactagacacagggcggtgggtctaggtcctatcccaaaggatatgacagactcttaagacctcctatggaaggcctcaccctcccttgaactcactcactctgtagcccaggctggccctgaactcactcactctgtagcccaggatggccctggagatggtgtccctgagtcagcctccctatgcacacaggcctggcttctttcttgttgccttccttaccagtatttacggtatgacttacattttttttttttttttcagggcaacagtgccatttgcttttaaaatgttagggtggctgtaagaccagttaattgcacagtgaaatcacacaggatcagaggtgaactaaaagcctatggatatcagttgggctccagtctgagctgcacattttgtcacagcagccagatcacggccacaaactccataggagcccattgttaaatagaacacagcggcaagccgcgggggtctacagagtccccaggagcaaggactcactctgtttctgctttggaagaagagcctctgttatttaccatgatgagtgcgaagcatggatgggttctaacagaattttatacattaaaacggcaaagcgagagcatttctcagtaactgtaaatgttgaatcaccaggctagaagcatacactgttttcttctgctgctggtctgttagataacatctagtcatctttctaataagctcagctcgaatataaacagccggatcccatggtctctggggtgagttttaacattgcagaccacacaggtattcatgagctgtgtgtaacttgacctcttcagaacaaggacagaacctactgcagaagttgagaaatcaccaggtttccctcagctggccctgggattgtgcttgactcccttttgcttggtgtctgggagagacctgcatgatagttttttctcactgatgtgacaaggtgcccagcaaaatcaaattaaggaaagatgggctcattttggctcacagttctgtggggttattccatcatcctgggagagaggcaacttcagttagagacagtggtggaaggctgggaagccagctggccacgtggcttccccccctcaggaagcagagtgagcaaggacaggatctggtctccaaggcctcaaggcccaccccctggtagctcacctcctgtggtgaggccacacagcctcctcagacagcacctctggatggggacaaatggtgtgaacccgtggagacatttcacatctgtcactagtgaaacacacaagaaagtgttttcctgttgggtgaaaatgtgtcagccccagagaaatggaggaattctgagagtaggcttcaggcattcccttggttggagggaaaataagggcagagagagaggtttctcttctctaaccagggcgactgtttgtgctcactcagaggacacctcttgctttatgccagacagtgtgctaacgtgacagccatgaagtgagtgtgcattccatgtgtgtttcacacttcggttgcaggagcccttgttcgccgcccgggtggtttatgacctcctcttcttcttcattgtcatcatcatcgttcttaacctgatcttcggtgtgatcattgacacctttgctgacctcagaagtgagaagcagaagaaggaagaaattctcaagacaacctgcttcatctgcggtaggtgcccctccaccctgtgttatgacgagagatgggtaaatcacccctaagataacggattgacaaactgcttagcaggaaggaggggtgagaatcatttccagttttcaggttttaggggaaattattttagtgtgaaggctggacaacattcaggttacgtaatgccacgtgagactgacactctctgcttccataaatagatgcaagaatcacccccaaactcccctgccattatttctgcaatttgtacagtcctctgactgtagagtgtgctgccagatgccaggaggttccaccaactggcagatgggtttttaatcacaatagcatattgagtgtattacagagtgactttttattttgctagattacgaatcacaagtttccactcattggcatcactatcttagattcaaaaccaggcattgtcccagtgttaaagctatacacatatacataatatgtatatcacagaccatacaactgctatagaacatgccccatacacatacatcatacacctgccataccccatgcaccggcagcacatgcaacataccacaggctgcgcgtgcgcgcacacacacacacacactcactcacacacacacacacacacacacattctccacatgtgcacacacacacacacacacacacacactcactcacacacacacacacacacacacattctccacatgtgcacacacacacacacacacacacacacacacacacacacacactctcacacacacacactctgcacatgtgtgcacacacacacccttttcttctgcatcattgcttacactgaaccaactttcccttcactgttatgataaatctttctgccaaaagctgcctgagttctatcgccatgtgggcagtctctgccagccacctaagttctgcctgccgtgtgaatggacaaaataatacacagacttgtattaggtacaaatgcttcttggccgatgactaggattctcaactgttagctcagtcttaattatcataaatctatatattttataagccttatcttatcggacgccttccattggtgtccctccttgccggtggatcacattgtgccgctggaggaagagcggaggggaaaagggacctttctgtttctccttgctcaaatatgagtctccttgctatgtcacttcctgcctggatcaccacttcttactacacttcccagaatcctcttcgactcctagtcccatgtaagttgctgcctcactgaccaaacagtattttatttatcatccggcaaggcaaacacatacacagaagcacttcccccatcacttcacagtcatcttctctcaaaccctcccccttctctatccatcagccctctctggcttcacttgccaccgtggtctctactctgaaccccagtgccacacttacccctctgctgtcctttggtcttcaccacagtgtcagaccatctgacttaaactgggcttctgtgcagcctgttctgtgcctgccgaggcttttcgcacttgtctcattctccttggtggctcctccaagctgtttcatcattcctccagctggaggtgtgcctggaaagaatgcgtgataatacacaagctctggggaaaatgtccatcagctgtgacctgcctgagcattcatgatgtgtgcacagacagacagacagacagacagacacacacacacacacacacacacacacacacacacacacacacacacacagatctcttatgtatcaagggaagtaacagagacctttctgggttactgaaggtgctaagaggacagacacctctgcagtcagggcggggagcagtaacagccaacatgtttccctggacacatggcacagaggtggtgatcagggacaaagggcatcagttagttgctgaagtgggtggagcaaaacagccaggaccagaggtggcacagaaacagtatgggcacagcctggggctcgctttgagtgtcgctgtaaccagacactgcagcttactggatgagaggtctattcgggttctggtttgaaggtttggaccaccatgacagggcagggacggcagtgagagcacctctcagctctggctgtagggatgtgaggctgcttgttcacatgctagctggtcaggaaatggagatgagctacacacctcaaggcctgctgtactcgtgcctggtcctccagataggcccacttccccaagttctcagacccctaaccagctgggttctgagcactaaagcatgtgccttagtgctgtaggactttcctacagacaccatagcagagggacaaggtgttgtcggtgtgagcctcagagtcttactgtaggtggaaaagctctgagtctagcttttgtttgagagcattgcagtagctctggggagtccttcatcaggggattgacctgaaggcagagtaactggttagtaccacagcccagatgacaagtaaggaagatcagtgatagcctgtggtgcagtgttaggggtgcaaggccgagtcaagaaagttaggtgatagaatcttaaaatctttttatttatttatttatttatttatttatttatttacttatttattatgcatacagtattctgtctgcatgtatccctgcaggccagaagagggcatcagatctcatgacggatggttgtgagccaccatgtggttgctgggaattgaactcaagacctctggaagagcagtcagtgctcttaacctctgagccatctctccagcccagaatcttaaaatctttttaaaatgtggatttgtttttatttatgcacattcctgattagcttgtatatatgtatgtgcaccagaggccagagttgtgggcaactgtgagccactatggaggtgctgggaaccagacccaggtcctctgtaagaccagcaagtgctcttaatcatggagccttctctccagctccagaactttgaagtgctgatgtttgggaatgagatgagaaatgactgggtgcatgggtgatacaaagaggctgagtatggggaggtgaggcatgaatacccagaatttacctcagggaagtgcgggacttgagagtctgtagacagtggcagtcagcccccagcccacagattacagcaaaatctggagcatgaaggacaactgcttggtggggcaagtggtgtgtaagcaggaagcagcacccaccaagggtcaggagagagagaacatgggtggaaagttcgcgaggagactggaggacacggcagagacatctgagaatgtgtgcgcacattccacactgctggctccagcatggtgggctgcgctgttgctgctgaggccagcgggcctgtctcagggagggctcagcacgccacttctggcccctggatccacatcagtacatggtgatatcctgagcagccctttggtgttcctcctggagggtgacccagattggagcaattccagaaaaggagtggacgagccaagccgtgcaaagacaagaaccttgtgggagtccctctttgggtggctgtgggcagatccaggtggaggatgatctcctgagcctggtgtcatgatgccaagaatgatgtgtctgtgagctaagatgaaaatgcttcaggggttcctcaggtcctgtgcattatgacagactccccaagtcttcactttataaaggtggcacaattgttgacaaaagcatctagaagagagcttgcttctgccactcaacatgaagagaagcaagagctctgagatctgcattgtttctgtgtcttcatggctcgtgatattgcctctcttcttcttcctccctccccctttctcatattcatctatgcatgtgtacatatatgtaagcacacacacacacacacacacacacacacacacacacacacgtataatttgtgaccaaatgccggagcaaggcaaacaaaaccaataacatgaatggaagaccctgtcctttggtttgtcacttgggaagaccctgtcctttggtttgtcacttaggaagaccctgtcctttggtttgtcatttgggaagatcctgtcctttggctttgtcacttgggaagacacttgtcctttggtttgtcacttgggaagacacttgtcctttggtttgtcacttgggaagaaccttgcccttcagtttgtcacttgggaagacacttgtcctttggtttgtcacttgggaagaccctgtcctttggtttgtcacttgggaagaccctgtcctttggtttgtcacttgggaagaaccttgccctggggtttgtcacttaggaagaaccttgcccttcggtttgtcccttgggaagaaccttgcccttcggtttgtcacttgggatgctttggtggtttacagagcaggctgctcagtgcagagctcagatttgctagaagagagctgaggccaaataacaatctgttgtccatgtctaactggatgaaggaaaatgaggttggggtgatacagccaaagagatgtcctgtgaccactcaggggtatggagaagaaacacgtctggacacctgaaggaatgcttctttcatcctgggagagaactagacccgtgcattttggaggaaagaaagaaaaacaaaatcaaagtcctctaatttctcttctttatgggacacccatcactgttttcacttttcacagtaaattgtttgaatattgccgtccaaaggacagtcctctttgtctgtgtctttggctcccagtgatgtcccattcctttatactagctctctagagaaaagagctctctagaaaagaggttttgatttttgccttgacccccatccccgacactgtctcactatacttttctcccatccatccccgacactgtctcactacacttttctcccatccccgacactgtcgtctcactacacttttctcccatacccatacctcgcttttgccgagtacacatcaccagcaccacactccccaggcttcattttctatttcatgtttactagactgaagctggcacagcctcctggcagccacgtggacccagcccaaacccagtgccctctcttctctgccttcctctgctcagctccagatcctggctggcatatggtagccacagacatgtgtctctgccttcggtgagcagggctggaagctccccctcacatcagtatctctgctgtctccttccaacacttcagcctccctgggccgacagatctgcctccacaggttcttactacaccctgtcacaaattctcgaagccacacatgggccggctcagtgctgctagactaactttcctagtacaaaagccctcagtaacatggtgccatccattgctgtaaactcctaattttcctggcaataagacactttacaatctagacccatctccctcctcctctccctcttctctctcttcttcttcccccttcctcttcccattctttagtgtattttcatccaatttatgtttcaaatccagtccaagtgcattccctgtcgttctcatcctggactctgtattcacagtagtgagagaatgttctggttgaaataccaaacccctgtgagccatagcactcaccccgtctctgagacccaaccccaatactagattcatgaacccttttgcaggctcactcggcaggataagcatgggtgctcctgaatggctgtcatcacgccatgctcagtgacatctgtttgcttcttcttgacggcatgcaccctcttactgtagaaagcatgtgaacctcttagacaggcagacacagccttccacagtcccatggcctgatgatgtagccttggccaaccttctttccctgagcttctctttgctgctctggaatgaggagagtctgcagccaggctttgaggctgtggtagctgtaatcgagatcttgtttataaaattctctactattgtgcagaggtgaagctaactgtgcttcttcaggagaggtagacccatagacgtattaaccgtttttattctcccgtgtttgatgtggggctcattcatcagtgtttgttaatgaatgacagtaaatcaacatgacattgctcgtcaggtacgcaaggaagggaagaaagatcaatactgagttgatctgtacttcatatcaaaacctagatgcagactggggagatagttcagtgaagtgctggccatcaagcatgaatgcctgagctcagacgttcacacccacatgggaagctgggcacggcggtgtgagcctgtggcacgctggccatccagatgtccgcactcacatcgaaaacatgagcctgtgaactttaggaggtggggcaggcttactggtgctcactggctgtccatgtagtactcaagcaaagtgagaagtgcttgagaaaatgctcaacatccccccctggcctcgacatgcatgtgtgcacataagcatgtatgtagcacacgagtacacagacaaaacctgactctgactatagatggctccaaattttgccacaaacttggtattgtctcagtgacatgacacgccaaggcacggatgacatatccagaggctcagggtgatgctatgtcaatcaagtctatattgatttttctggaagcttcatgcttattcaaaagactgaggggctgtttggtaacctaagctcagagtaaatctaaacaaaatttttgtattataatcaatagaatatcgtgaagtagagcaaatttgtgtgcatatctgaaatgaaattgaaactttgaaaaaatgtgggctggggatctatagttgagcatttgcccaccatatgtgaagaaccaagtttgatttccttttaccaaaagaaaataatgtaaactggggacagagagctgtctcagcagtaaagaacacacgctaagcatagcttagctaagtagaagactagactttggttcccagcatccatgtgggtggcttccaaccacctgtagctccagctccagtgctctcatgcctcttgtggcctttgtgagcatctgcacacatgtgtgtatatacaccaacaccacacacacacacacacacacacacacacacacacaaagaggcctggataacaggttagctccatggtaaagagaagtgctgtggtgggtgttaccagaaactcaaggcagagaataaaagtcactcttgatttctcttattctcctagtccaagtagattttatgccctctcgggttttcactctgaaatgtttcttcagtcttctccatcatttattcagttcttccatcaagtttagttgaattcctgtggttgtctgggtaatctgtagggggcattcaaaatctaagcagacaggggatcagccatctggttgtgtctgtgggagccggtggcgccaaaggctgagctgggtcttggagaagaagcacctgcaaggtggaagagaggcagctggagacaagagtctttctgagaacatggagaatttggagggtggaagaaaggtccacgaagaggtcagcacaggagtctgagagtggcttcaagtgccagcccatgggacatcctgattgttatcagaagtggaaaggggggcagagaaacaacttttcagtgagctaagttggataagcccaggagctagccctgtggagttctctagccagctgctagatatggaagtgaacttggtaatgaaggtcagtcttggaggtaatgttccaggaaccaccagcgtggtgatggttatctttggaagtgaatgccgcactccagagagcaagagcctatgagcatgaagtcaacatgacccccaacttatccattctcctccattgtcctggctccttgccctctccatcagtctcccctaccatcccccaaagttctgccccaagaactacttcaagtatagttctgaagctgctgtttccacccacgagtccacagcacaaaggggaaatgccatagatttcagtttgagcaccacagtagacgggtgaccttttctacaccaggccacccacattcgtctctagctttgccacctcgaggcctttgcccatgtggacctttagagtcaggagtggctctgttcaatgctgactgattcttcacctaactacaggggttagcttgaaccgttctggatctgtttcttggtgtggataaacgtcatgtcggatggtagggtttttagacagctttgtggtcgccagcagaaataggtgctcaataaaacccaggtagaatttacgagcatgtacctctcttccgcttgctgaagtcatcttctgagagtctgtaaagctgtctgcctcctcgaagccgtttgtcatcttgtccgctatgctcccttgcccacacaagctgcttcagagcattgcacgttacctggtcccgctaccacgttctagggtgagtgatgatggaatcagtactttaatactctattactttgcagacaggggagaggcttgaatttaattctggggaatcttactttaatactcttctttttaatcaatagctctattgtgatgtccttaaaactcaccaacttaaggcctacagtgcagtgcctttaacgtattcagaactgggcacacaactttatgatccatttcaggacatatttactgccccttcccataacactcatccatcatgttctcagcagcctcccatcaccctgtgccctggccgaccgctgatctgctctctgcatctgtaccttttcctgttttgaagattcagttaagatatctggtctttatcactagcttgatgcttgcaaggctcctgtctgtgctggtcactttccccatggctgacagactatctgactgagcaacatgcagggggaagggttcccttaggctcacagttcaggagatacagtccctcgtggcagtacggtatggcagtgggccagctcctgggagtccatggtggctgtgggaggtgtcgtgctcacatctcagtagactgagaagagaaggtgaatgtcagtgctcacctgcttcccctccccccttcactcattccagttctctagcccataggatggcacctctcacattcgggctgttccttccttcctcagttaactctccctggaggcaaccccacaacacgcacgtgtgtgtgtgtgtgtgtgtgtgtgtgtgtgtgtgtgtgttttatgtgccctatatgagaaccatatatatggtcatcagaggccagaagagggcatcagatccactggacctggaagtacaggccgtcggaagctgccatatggtcctctgcaagagccctgaatgctcttaaccactaagatatctttccagctcccccagttttttttattaattcagattgaaaatcaaaattagccctcatgctgcataatacctcacgtaagtgcttccagcctttctattgagcagagtgttctatcggatgctgagaccgatatcagaagtcttctttctgctcctcacgggtgggcattgggtttttttttcaactttggggttgcaggaactgtgttgcagtgacaatccttgagcagggtgctgtgtgtatgtacattctcccttcatgggcacctgggcatgatctccttagtcatgcggtgactgtgagaattctttagaaatggcttgttttgcaaagctgctgccctgttttacatttcttttagtagcctgagggcccagtatttccagaccctcccagcactgtcatcatctgctttcaactttagtggaagtacattttactactgagtgctcttaactcatccaatctcggtttcattgaatgtcaactgtgtgtcagacacagttgtaaagtcttagggccatggtgaagagcagaggcacaggtatctgtagtcgggaaagcatgtgagtaataaatattaggccaggcttggtcgaacacgcctataagcccggcaatcaggaaactgatgcattaagatcctattactgaagccagccttttttttttttacatagcaagttccaatccagccagggctaaataatgagacactgtctcaaaaacagaataagacaaggaaggagtgagtatagatgtgtgtgcacggattcgtgggggagcacatttcttcctccatgctggcccgcagcaggctctccctcgaaggcgtggctactctgttacctatgagtcgaattgggatccagtgtaatttagcaatttccacactgctattgtcagtgtgatagaaagtggtgaactaggaaaggagaggcatagtgacagatggcccagagtgccaggaaatgacaagggactgtgtgtgtgcaggacactgtgtcaccaatggggagggactgtgtgtgtgtaggacactgtgtcaccaatggggagggactgtgtgtgtgcaggacactgtgtcaccaatggggagggactgtgtgtgtgtaggacactgtgtcaccaatggggagggactgtgtgtgtgtaggacactgtgtcaccaatggggagggactgtgtgtgtgtaggacactgtgtcaccaatggggagggactgtgtgtgtgggacactgtcaccaatgcggagggactgtgtgtgctggacaccgtgtcaccaatggggagggactgtgtgtgtgcaggacactgtgtcaccaatggggagggactgtgtgtgggggggacactgtgtcaccctaagtcacctgccaatcagagttcaccagaaacatccatgaatgagttagccaaggacacagcagcgaatgagttctgtggccagaggaaatgcctagcctcggcccctgatggaggaatctgtctgtggaatagcagaggccagcatggctgcttatacaccagcagggggaggtgaggaggtgaggtcagagcagcagtggagccaggccacgtgggagttagcacctaaacgttacatgagacacagacagactaaataactataccttgtgtttagtttcctcttctctgtaattggacacctggcatactcctatgtaaggaggaggggtttgcttgggcttctactccagaaaagacaatagacctcatggcaggcaggacattttcagggacctgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggacctgtcctgcctgtgtgggtgggtggggggggctgctgactcacaccttagtagataaggaagcagaacacagaaggctggcacttagctgccttcttccatcctgatgcagtccttttagtctggcctgtgggatggtttctcctacattcaaaggaggttttctcctatcagttggctgtctctggaaacagcctcatggacacaacccaacctattccctaggcatcacttactccaatcaaaaattctggagctggagagagaattcagtggccaaggtttcaagcctgagacctgagttcagaactcagcatccacatgaaacgcctggcaccgctacaggcagggttgttaacccctgcctcatggagacggagacatgagcaactctgagttgctagctgtcagtgtgtctccagcttcagtatgagaacctgcctcaagtgagtaggtcagagagagccagagtaggagtcccataccctgcccgcccccacacactatctccaccatctatatggaattcagctgtcactggacgtctaaatcttaacatctgtgttttatctaatactgtgtaagccctctctaccggctgttgtgaggggctgctgtgagggccacagccaagcagagcctccacattgtgaggttttccaggagtgactccagctcccctgctgggagtagagggcacaggtggacacaggcagcctgggccgataatgagatgatccacacacacaccggaaggcaatagctcagagcacagcctcagcagaggaggcccttcaacacagacagacgcatgtggatatgtgctgaagaagaaatagaggaatttcaacgtggatggggtatggcgtgtgagaagcagagaaaagccaaggatgactcctgggataatgacttggacaacaacactggagtagccactatataaccagagggaggctgtggtgggaacacattggagctcatgtccgacacgatgaactgataatgggtcaagtgaaatgaggtaccatcaccagatggctgtattttatacagcattttcataaaaaaaaatccaataacaacttcaaaagtcaacccatcactggggacagatattcttaaatgtatttgttttgtaacatgcttaaagaaaggtttcttcatgacctttgaaatgtgcacagggaaggagtagtcaggactggaactcagtttcctggcgtctcctctactatctgaacagcaaagatgaactcaaccctgacatcccgtctcccacaccagtaagagttgttttcccatggatgtttctcttcctctccattcactgtcttcataagctcctcgcttgaagagaaaagcctgaccactcaaatcctcccataagaaggccagtaagcatcagctcctgtctccaggtcccagccctgcttgcgttcctgcctcgacttccttcatggatagtctatgaattgggagtgtgagccaaacaaactctttccttccagtttgctcctcgtcgtggtgcctcatggaagcaatagggttactaaacaggacataaattgtgccaggatggtggggtgttgctgtgacagacctggccttgtgttttggggaggatcgtggaaggagtttggaattttaggctagaaaagccattgagtgttgagagctcagtgggctgttctgtaggagcttggaagacaagaatgttgaagtcattgtggatggtggaaggctggcttgtgaagtttcagggggaggtttaaaggctatcagagccatttgttattcggacttaagatgtggttctagtcagctggggctgaagaattagttgcgattaacaagagactagcgccattgacgtgaaacctttgctgggacaactgatgctggttaggtggagctgagacaataagcggcatcattgaggaagtgaaatcttgaggaagtgtttcagagagcacacagaaggttgtacttggtaatggaagtgtcacccaggtgttactggttctgaaggcatgaagggggcgtggaggagcagctgaggcttggctgtgggaaagcccagaagtgttgcaggtgaccctgctcagacacccgttgggggagggggtgagaagacgcagcaccaaggactcaggcactgggagtcagtgagtggcagactcatttattcaggaaggtaggcctgcctttatacccactcccaaggttctgtttgctcagcggctgactctgctgcgttgtccttttctcattggtgtctctggtcaggtgtctcttcgtcagtagtctctgggcattgaggcaggcttggcagtttggttcagggaggaagtgcctgccgcgcatgctcgtgtgggctggcctgggcacctgaggcagggtgactggggcttgggtaggccggccgcagtttctcctacaccgaagaagccattggtgaaggtgcagcctcagtagcagtggcagccctaggattaaagcggtcatgaagagaagccgaggcttgtcaccatgaagagaccccaggaaagggtattggtgggagtgcagcccaggtgcagcgggaagtcccaggcgtttggagatgccagtgctgtgaggtgaccatcaaggacagcagccgcagtggagtggagcctggctcagcttagagtatgagctgtgtgtgcagctcagtgtggtgctggaggagcgacccaagccccttgaaggagcccagaagataataaagaatccagacattgaacgttgagttgtttacgctgttggagcttggttttgctttgatctgattttaactgtgctctgactcttccctcttgaagtaagaatttattatttaacttattttcttattttataggacccacagtttagagacttttgattttaaaagagacttggggtcttttaaagaggaggaactgttttttgagtttgtaaggctgtgggacttttaagtttgtaaaatgttttacaatgtgatgtttatattaaatgtgtgatcttggggatgaacaagaaaggaaaggttgtgactttacagtgatgtttttgtgttgacaagggattgattgggctgtaaagttttatttcaatttgacacaagctagagtcatcagaggggagggaacctcaattaaggaaatgcctccgtaagatggggctgtaggcaagtctgtaaggcattttcttaattagtgactgaagtagggaggcccagcccattgtgggtggtgccatccctgggccgatagtcctggggtcttcaagaaagcaggctgagcaagccataagaagcaagccagtaagcagcaccctccatggcctctgtatcaatgagctcctgcctccaggttcctgccctgactccttcagtgatgactggtgtggaagtgtgagccaaatgaacccttctccccagcttacttttggccatggtgcttcatcacagtagtagtacccctgactaggacacctgagaattgaagtggccacccaagccccagcttccctgagtgtcatggaccaggggccctgaggagagtccttacccctgcacagtgtgctcagggctgtctctggttgcaagtgactgaaggcacgactcagatgctttcctttaacccaaggccttgatggaaaggaatctctttttttattcctgccacaattagccagcattccttttatttgttgttttctttctgaaatccttattgtgcctgtgagtgtgtatgagtgtgtgagtgtgcgcgagcatcagcctgtgtgagcgccacagcacatacatgtgggggtcagaggacaactttggagtcacttcttgccttccaccttgttttgaggcagggtctctcttgcgtttctgatgcctgtgagcttccaggcatatctccggtctctgcttcccaccgtgcagtaggaatgttagggttacaggtgtgctctgctgaacaggaccttctgtgaactccagtaatcaaatgcagattacctggcttctgtggcaaatgctttccttttcttgaacaattatcattgtctctttccgcttatgcttttggcctggttgagtttgatagttttatatggtctacatttaagatcacctgcaattctgacctctgtaatagaactgcacactcccaaggatcacggggaggaaaatacatgttagttgggaatgagtctataaaccacagcctcttttatctagagcttttctgtattgttgtttctaattgtaacagtattttaaagaggcacactcttccagaaagcaggtttgttgttgattttttaataatggtcatttttattatgtgaagaagtcatgattaacagaaaaattgcatacagtgtttcctgtgttttgcaggcctggagagggacaaatttgacaacaagacagtctccttcgaagaacacattaaatcagagcacaacatgtggcattacttgtacttcatcgtcctggtgaaggtgaaggacccgacagaatacacagggcctgagagctacgtggctcagatgatcacggtgagtaaggctgcctcagccagtcctgattctctaactgtgaccgtatcagaggccttcagtgtccatctctcccctgccttcctcttaggtgagagatgttctagctctggcttttttgtgagactttacataggcttgtcagttactggataattttgacattgctgacatcatccttgttatccatcaaatctgtgtctccagtgaacagataacatgttttcagggattatctgtgtagtgaagagtttcctactaaagtctctaacctctggccccaaacctccagtcatcactggacctctcagttctcaaatctggaagtttcatattgtcacatgcaaacaaaagtcatgcttcaaaagagtccttgaatttccaaaatcaataattgaaaacatcttgtgtggggttttggatgttctaggggagcctggtgggagaatgccactttctggttttagagaacagctgacccttctgttcagtcctaagaatggtacttgtgtgggggagtgaggtgaggagatcaaggtgaggagagggaactaagaagaggggttaaggagagtcagtaaggtaaggaaagtggctttgacctgaccctgaaggagcaggtcacctatttagataaacaaagacacagtactggccacagcctgcttacccatccatccatccatccattcatccatcatccatccatccatccagccttcatccacccatccatccatctgggcattgtcttattaacagtgtgggttgacacagtgttgacgtgcttgtgtgtctccagaacactttgtataaagagcttccgtaccttggcatctttcaggcattctcattcctgatttctgattatggctgctttctctgcatccttcctttgagatggacagaatctagtagtttgtctgtccctcacatttatctctctctcctcttttctaaatgtgggggaaaggtaatgagtcccctgagggactctgtcatggctgtggccacacattctggacagtgtttgtgggaaacatttcccagctgctcatcaggagaagggcatctgagatgcagaacttacagaatgtgacctcacggctgtaaatggaataactgtgtttatctggctcccctcaagtcttttgtataaaatatttctgggaatacagaatacgcccccttctgtagaactcaattgtgggggaacaaccagctggaagtgggtataccaggtgtgcccagtcatgtgatgagaatccaaagaggctgaaagtcagagtggtgctcggtgtggaaaggtatgtcagggtgtctgtgtggcctggggggtaatggacaaggcaggacttgtgcagtgaggtttgtctgctggatcagagtgagttcctgtgagaaacagccaaacacaggctggcagtaagtcactcagaccttcagaggtgttagttagctttcatggtcagtgtgacaaacacacacctgtcaggcctcaaaggaagaaaggtgtgtgtgtgtgtgtgtgtgtgtgtgtgtgtgtgtgtgtgttagcacgcatactcttgaggtggggagttgtagttgtgcctgcatacacctacatatgtggaagccagaaattgacatcatgtatatgtctctatcgttatcactttctaccttatatttgttctgagatagtcgctcttcaaatctcgatgtgatagtttgaatgagagtgactcccacaggcttgtatattttcatacttgatctgcacttggtggaaatgtctgtgaaggattgggaggtatagccttgtggaggaggtgtctggctgggggtggcttagaggtttcaaaagcctttgacattcccggttagctctccctgccttgtgcttgtggatcaatatgtaagctcttagctatggctccagctccatgcctgcctgcttccatgctctctaccacaaaggccatggcctctaaccctctggaaccataagccaaataaactctttcttctataagttacctttgtcatggtgccttattacagcaaacataattatgacactggagtttaccatttcagctaaactggctgctcagtgagctccaaggatccatttatctccaccacacccctacccagcactggagttgcaggcacacatgctaccatgccaaggatccaaacctagtccctgctcttgcaaacagcaagcacttttcccactgagctgttacctggcactgaaagagtcattttgctcatggttccacaggttcagcgcacaaccacctagctctgcattcagggcccagtataaggcaaggtatcacaacagcgggagactcttcacctaatggccagcaggaagcagaaatgcccacaacttggtggataggaagcagagtggagccggaacgggaaggggcaagggcaagatggaggctctagggacatgcccttccccagtgaggcctcacctcccagtagctcagtgtgatagcaagttcaccagtggatcgatcactcactgggttgcagccatggtggtctgattgtctccagccaggtcctcatcttcacacatgtcattcccacatggtgccctaatgacctctcaggtgctgacccatccaatagaatggacaattgaggccggtcagatactcagggcctccttagtggcccagtttcactgctcgtaggagactcacttggaggaatttctgagagatggcagaaaaagctcagttgaaattctaagtagtacatgtcagcgtctgagcatgatttcactagcaacagaaatccactgaaggtcactgcccagagagcagtgtggcctgggatggtgtcaggaggtggggtgcaagcttctgggaaaaggaaaagatagcaccactgatggcatttaacagtgagtgagacagaggtgacggtggggaaggagggctggacaaacctggcacaacaacctaggctaggcatgcagacgagaaagatggtgtcattgggataggacctctgtcaggaggagaagccgtttggggaagagaccagggtctgaagtgagattggaaattgagaatagtgaattttggggacagtgaaatgggaggaacctcatctctgctgcagggtcctggggattgtaggtgagtcctggacccatctcttaccctcacctaatgtggagagactgctgtgttctccctgacagacaggagtgtgtatgttcagggtcatggccgcactgaaagcaggggattggtgaattcactagacccaagataaatgataaatgggtgttttattggggaacaacttacacagataagagtaaagaacagtgggtgttcctgttccttccgatgccagccagggagcctgacctgctgcactcctctaccttctggtcatgtccacacctgaagccacacccaaaggggtgtggtgattaacacaaattcactgacagggctagatgttactacacagcactgcctggtacagtgcctgcattgttgctcttaatggtcttgtcgctgtgtaatccaggttgtcctggaactcccaattatccagccttcatcttcctaatgcgggtgtataggtgcagccaccattcctggcaagtgtagggacttacatagttctcactgggacagcatctgagccagtaggctagcaaggtgagcagaggaaggcaatgcaaagagagggggagaggccaagtcacagctgggaacctgcttaggaaactgaaggcagacagacacaccacagataaataggacaagaaggcaggaggctccaggggctgaaaatgtcaagttaacagccacaagaagcgtcaggtgtgagctctgggctccatgagatggaaatctcttcctgcaaagaaaactacagtgaagatatgaaaccatcttcagacctgacatccgagcagcattttatcaggcaatccctttgagtgtctaagtgtcacagttcttattgaggtcctgccctgcccacctatgtcagagcccttttccagaaaagcccaggagagataagagtctacaagtttaggctagcaggaaaagtctcgttcttgtcctagctatatgtctctagaaccaagtttctttcctgaattattttaatcagcagaaaagggagaggcatattagctcaagtttgatgcaaataagacagttcaggtggaagattgctgattccagcaaagcaaaagcctgtatgttacacacccaattcggaaactttctcactccaggctttgtgggtgtatggctgtgtggtcctgattctccaacagagattttagcacatacaattccacattctggagtttagaatcagacagcacgtttgtgcttctgtgtccaaccagtgacagaaatctttgtaaaatattagtgtccctaactctggaaacaggcttcttactaaacagtgcatggatatttgaatcagcacagagcagaccagtctgggagatggttagagagggtgtttgtatctccaagctaaatgtgcacgttttctcctggcgagcaaacttttgcctgtggtaagaggattggcgtcactgggaactgagaatgagaatgagaagggagcacccaggaaagtcggagggggggggggggggggggggagaagcaggtgaacacggaggagctcctggctttttcctggcaaaacttcgagcaccacaaagcctgtttgcttttcctgtcatcccaaagatgacatctaaggagcagcaaaccgaacagagatcattggagaaagtgtacaagatttttagccaacaacttggagacattctcaggtacccatgttatctgcggagatgtattgggggctttggtgatatttgctacttaatttgacaaaaggctcacaccaaaccagagctgcacataagaggaggtccctgtgtattcaggggatggctgatcctggttgtccctgggatcccttagctacctgtccatgaccatgacttttaggggccacccctgacagattattacacctctacatacctctgttcattcaacctttaacaactacttcctgatgtctgcagtattgacaaagacagtttaattcatattttttggtagcacaatagtctctcttcacacacacacactaatattattgaaggccttagtagggtattgctggctcttcgctctgcacacagcctgggcaactgatatctgaaataggtcagaagcaattcagtagacacgggttatccccaacatgctcgggactatgctaaaagtttgatgtttacagctaaataagaagttatccaccaggtgttggtgtcgcacgcctttaatcccatctctcgggaggcagagacaggcggatctctgtgagttcgaggccagcctggtctccagagtgagtgccaggataggctccaaagctacacagagaaaccctgtctcaaaacaaacaaacaaacaaacaaacaaaagttatcgcttccttgaggaagcttaaaacattcactgaatgaataagtaaaacaaaaagtgaattaatgagtgattaatttccttctagctcttctagccttctggcaactggacataatttgtagaaccatgcaccaaatcaagctgctccaagaggttgacatttgaatttctcatcaagaaagcaggcttttcctttctataaaaccaaaaggtgacagggtgctgtcaccacaccatcagaccagcgctttcatttactgtggcctgcccctggcacgctgcagcccagctcccccatcccacacaggaggaacaaggaacatggaagagaataggtgaggctttcagtttaactcagcctcaagaatgggtcctgtctggaagctatctgctatgaccagagaaagagagtttttttagtttcccactgctgtgataaaatgcttgaagagcagctcgagagagggagggttcgtttgcgtccatggttcagggaccagcaataggcatgtgggggcaggaatcgggaggaagtgaaggcaaacacgtgtgctggcaccccctttctctctgcattcagtctggaacctcctgccctgaggtggtgactctcacactcagggtgggtcttcctttcccagataaatccctctggaaatgccctcataggcacacccagtgtgtgtcttctgggcaattctaagtccagtcatgctgaacatgaaaatgtgtgatcacgggtggcttcatctttctcatgagacaaaaagaaagctaatcactcacctgctgtagccacacaaggagccaaaaagaactaatgactttccaacattgatttctgagtctgcaacttgaaataggtcttgtttagctaaaccatatttgtgagcagtaaccggcaagggcaggggatgtttggattcatggaagacttcaaattgtctgagatttacttgtcgattgctttctccagtgccatttccagttaggtttttgcattattgttatgtgttgtaattatgaaattatatgttctgattccattctttttaatctaccctgatttcataattggatctaatgaagccaattaggtaactgcttcatttttaactaaaacctattttaaagatttgggggcttaataagacactttttaaaaaatgtttccgtggctaggcaagccaaaggggtctttgcgattcaaaacacatttatgcgggcagccaccaccttggctgcccactggtgtcttcagcttcggaaggctctgctcaagttccggcctggggctacccctccagtgcaggaactgcccagtgcattgctcttgtttttgacttagcatccatatggaaggcccagaaattgctaccttgtaatgtgggcacgttcacccggtgtgaacccctctggctattgtgaaacagaagttgagagtatatagccgtgtggctacctcactccgtggggacccatcacctcagactctgtcccagcgctagacatgagggcaaagggatttgagctttattgtgtcaaaatgctttgggtgggctgcaggggcgggggtggggcagggagggagcaggggtgaggcagtaaggtaaggagtccgagcagctccagagtactgattgaatccaggaaagaagcccatggaagtggggtgggggcacctgctttacccctctgctcgtgaatcgccccgttggtaaagtacgcatagtgggtcagtcagaaggcagaacagaagccaagtgaactgaattaagaccccagagaccccctactgtccctggctgtcctagggtaggcattcatggtggggacacctcagaggacgagggagagatttgtagatcttgagacagtaggtaacttgacgacaggatggtggtctgtgccgtttcagcattcccatagccctgtctcagaagttaaacgtggtctgcacatgagcaaagccccttgaggaactgcagtgtagttcagtaaaacaacacacacttaagctatcacagacacagatgaccttgactctctgtcaaggctgcacaacaaccaagaggatcctgataacatcaccccattatacatttaaggaggccaaagcttagagatgacctgcccagtgtagcacagggaacccaaaggggtggagtgctgtgcccacaatgcaccacacacaggaacagcccctcaagtctcagtcaggacccctgtgtaacacagaagccctgcttcctctgagagcaagccagcccagctgtcctcggcccacccagcagcacccgtacagaggagcaattttaagaattcagtccacagggcagggagtagacctggctgggagacaggaagtcagatgacagccttgcggtggcagggaagcctgagaggaattctaatgggaagagagagctggctggtacaaggacaggaacatcatgactgcagttgtgaaagcttaggctgtctctgttaacccgacaagggttttctgggggacactctgcaccagaccacgataaacacaaggaaaagaaaaaaacatttgcaccctcccaggatctgttctacagattcacagttccacatggaggaggacggacttgccaacagccagagagactgaagagacgtaatcattcccctaggacgcagttcctcctggacctcccactcaggttggccccagccttaccaggtccatttcacctacctgctttcatagccagctacacttcagctagcttgacattgtgggtttgtgttttgtttagaaaacactctgcctttctttgcctggccacagccttggcatttgtgtgcagtctgttggccttcgtgtgccccgactctttcatgtcgctggccgtgtttcttgtcaccttccatcccaatcccattcccactgctccctctctttgtccttaccccccctcctctaccttccctctccttttctctcctctctctctctctctctctctctctctctctctctctctctctctctctgtcatctcttcccccctctgttttttgagaccaggacttgctctccagcacaggctgtccccaagcttacagtcctcctgccccagccccttgcatgtcagggttataagtgtaagcctccaaaatgggccccatccttttagcatttctttacagccgtgacttgttgcgcacagtggcttctttatcctctactgttacaacacacccccactagcacatttacacagatggttttgtgctccagtgtcttcctagtccagagttagtgcttggtgcacagtgggcacttgcatagatttgctgaacaaaacagacatgacagagagcggctgcagtagagagggcaaagcagtaacttctgcaccagagacgcttcacagaagtgactgtgagtcaagttgagccttttaaaaatgaggattttgacagaagagacagagaggaatgttgtccaggcaggatatgtattgggggggaaagagggagggagggaaggggagggatggtgggactgaaagggggagggtggggaggtggggagggctcaggagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtggaagggggggggggggcacggtgtgtctgtgacaagagtgacggtcaagaggtcaggtgccaaccaggacacagagtgcaaagggactgggagcttggagtctttattctatccggaaagctaagagagcccattcagagacagtgaacccaaggtggggttgagaggggcacatgagaaggcacagtctggggcacgaggtggtaaaggcgctgccgccacacccaaagacctgagttcaagtccccagacccactctgtggaagaagagaactgaactttgcagtttgtcctctgacctaaacacacacacacacacacacacacacacacacacacagacaacacacacacacacacacacacacacacaccacacagagacacacacagacaccacacacacacacatcacacacacacacatcacacataccacacacatacgccacacaccacaccacacaacaccacacacccaacatatacaccacacacacacacacatacaccatacacaccacacacacatcacacataccacacataccacaccacacacacacacaccacacacatacaccacacacacacaccacacaataccacacataacactacacacacacacaccccacacacaataccacacataacactacacacacacacaccacacacacacaccacacacaccaccacacacacacacaataccacaccacacacacagagacacagacacatatacatatacatacaccacacacacacacaaaccacacacacacacacacacacacacacacacgagagtgggggagccaggggggcggggaggggagagaataagtgcaatttaaaagaaagcataatcataatccacaagaaatgacaagacatcttggaaataaaagaaaaatctagaatgattcactctctggcagcaagactaagagcacacattgaggagacggcacggtaacggagagttaaaggggcctcgctgatcacggagcatcttttagtcttctggtctgtgtggttgtgggtattgaacaagagagggggacaagagttgcagggctggtggcaaagagaagtgttcgccccagactggcttcctgtctgtgggcacagggcctaagaagaaactgaggacgtgagtctggggtccatttgggaactcagaaatgaagtggtgtggtttgcatgggaaatgtcactcttaggctcatggatttgacacttggttctacagctggcagagctgtttgggaagggttgtacagtcccctagaggccttgagggaagaagtgggctcctggggccttgagcttcttagcccaggactacttcttgtctgcagtctgcttcctgttcttcttagatgtaaagagtccctgccacgtggtactgctgccatgcccctgtctccacgttgaaactgtgagctagagtaaatcctccttgccagacattggaccagagctattgggagaatataatgtgtgtaccatccacaaagataacattttaccgccgtctgctatgtagtagatacaacaaaggttccttagccagaagagatggctgagcagttaagaacacttgctgctcttgcagaggacacaggttctgttgccagcaccccctgggggttcacagcaggccataactgcagtttcatgggatccagtgccctcttctggcctctgtggacatcagggacacgttcagttaacatatatacatgcaggcaagcactgatacacatcaaataaaaacaaataataaataaaccaaaaacattcattaactgatgataaagttgtatgtcactcaagtggtgtacttggagtcacaggttttgacaaggctcctttggagactgtgtggagtgagtgaagaaggggacgatagctcttcagagggacgagatgatgacagcaagctgaacctgattatgctgtatctgctccactcaacaaaatgcagagctagagaagaaaaaactttctctaaaaagaggtgactttcaccagccagtgaacctagacgcggtctgactggtcagtagactgtgacccaagaccgtaaggtttgcagaatatgaaactgcaacccagatgttttattgagcatgcagaccctcagtcacttatttccagcttaaagagggatgttcacatctctcgttttcatcaccccagcgaaagctttctccctgctgtgccaaagaaaatcctcgtttcccagttctggtcattactgtaaggtcttgttgaattctcagtcggctttctggaataataatatccacattgttaggactgatacgttttactcagaaatgctggctttcttccagagagtagccgatgccgtcaagatgtgagttgtgggaatgaaaacggtgtacggtaaagccacaagacccttgctaatggcttgtaataggccaggccagcccgagccccattacaagcaattagttaagacagcagttactctgcacacactgcttggcatggggtaaggttatcgggcaagctcatttccttggggtttcggtactaattgcatcttttaaaaatcttgggaaaatagatgctgaaatttctagaagtgattcagcatttgtatgtgagagaccagccatttaatatcacaaccagtgggctccgatactttgtgagattgagagatgaaggtgttgtgaaataatagtgtctgagataggcaaccccagctttctgggtctgtttcctcacctctgaaccatgagtcttgtgcttgctgagatcctgtgtggatttacacgcatccccatgccaaatgaggtgagtggcttgtagatcttgaaaaagggattcaccattccactcctactgaaaaagctggtttaattcaaataacgtggctacacggaaacactcctttgcatatgcaaagtgttctcgaaccatttaatgcccacacactctgctccgaggagcgtactatacatgtgagtgagctgtgctcatctcttccctgcgtttattagacacggagcccgtgtcctcaatggtaacagcttttgtagtaggtcagaattgacaagaaagggagagttcatgtttggagcagaagggagaccccaaacaccagtttcctcatgatttaatggtgagtgtggccaccagggaaaagtctggccagagggacttctgtatgttactgtctgatccaaactcaaattcttacagcacatgagcctttgataaacctgaacgtcaggaactctgtaaatttgtattgctaggaactctggatctacctgagtttccaaggtctcaggacagtttttagcatggttacataaaaccatctggagtgcccagggagcatgcagggacaggtgtacccgaaagggagcagaagccttgatgctgaggccatgcaagaaggaattctgtctggctgacatctccaccttgagggagcttccttgtttttctctctgtgatggggacactgtggggtgtttagtcagttcttcagagaataccttcgtcagatcttccaatatttgaaaaagttccagcaactcattattctacacacacttaaatggaacttcaggaatgaagaagatgggagagagtatccaaattatttcacttcctcttggtttgttttcacaaaatgcagggtattgactgtgtcaaaagacccttgggagggctggagtaatagcttatttagtaaagtgccctgagttcaatccccagaatcgacagacacaacatcaccacaatccagacaggatattgtctgatagtaatcccagaactggagagttgaaggacaggaagatctctagagcttgctattcagccagccttgctacatcactgaactccgtgcggtgagagacccctgtgtcaaaagacaagatggatagaagtcattcaggtttaggtcaacaatgcacactgagcctctctcttctcttcttcgtccagtggagtatttacccgagaagggagagaattctgtcctataccataggcaagggcagtgtggtttaaaacagggttataaacatggctgacaggcgagtgtggtttctctggtgatctgctcaaattgtagtgtgttaatcagctttcagttaccgtgggggctaaagtaccctgaaataaattattaaaggagagatggtttgcttgggcttctgtttcagaactatgagcctttagtatcttggtccctatcacattgtacctgagtggaaggcagatgtcacgggggagtatatataacaaagtcactcacaccatggcagctgggaaggaaaagcgaaaggacaggttctctgtatccccttcaaggatgtgcctcagtttacctcctacaaccaggtcccgcgtcgccacctcacagttccaccaccagctagaccccaagcctttctgagcattccagacccaaacttgaacccacagggcagcaggctctcctagaataaacatgtgactctttgttcctctttctccacactgggtcttggtttgtttccatttccaggttttcttctcttcatataacttctttgttcctttgattttcctatctacatttcacgaggtttcttttctctgatttcacgtttcaagcaaacctgcttcatgaaatagaatcccttcctatcttcatctgtgtctcattctcagatgtaataaaagctgagatcaaatcatctttaataaagaaaatacagagtttggagagcgcaggtgaactgaggagaaagaaatccatcaggctacaacaatcacagagcgcaaagccccgctctcacacagtgccatgtcgagcaagttagtagaggtgattaagatgtcatagtaaagttagagctgctttgtttggtttaaataacactgatgtggtttttttttttcatattgttacatcttcccgattccagcaacagtttttgatagagaatttcgcacagtttgattgaggacctttaaagggaatagtccacatccaaacaagtgtaagttctgtgaatccatctctagaatgcagtccactgtcgtcatgcagtaggactcagctaccaagaactgctttatcggttgagaatttggtggaagttgaggttttaaattatcctcaaagcccaggttcacaagtcactgtttttgactaatcagaattcaggcaagattagttatgcccttcacaaatcagggtgactttctctagggcccagtatccatctgatgctgtctctgctccctggagaaaaggcccagaggcagcttacagaactgcaaaggtttcctttggaggttagccgaaaggttttgtcttcttgtggctgctgaagcattagcatcggttccttttctagaagagttctctgcaggttgatgtattgtaccttctcagaggggaacatactcttctaggtggagcatatcatttcatcctatgatagacatatatgtgaaggccacagcatgggtgagtgggacaatggtcccccaaactgactttcttgggccagggatgtggatcagggaaaagtgtctgcccaacatgggtgaggctcagggtttggcgcctggaacctcaaacagctaagcatgttttccttctagtcttctaatcttaaatcctagaatagcagtggagaggaacatggtggcttgttttttaatgttaatccggcaataagaagggagattttattctgaagttaaagcatacagaggggtgtggccgggtcatctcattaaagatagcctgctaacaaaaactctgaggaaaactgaagggacaaagaagctctgcaaaataggtaacagtatgaataaatcaaactaaaagtgatgaaggggaccggtggcaaaagctttgtcaaagacagtcacatgatcgtgaaattgtagttaaaacccgaagcttcagtacttctaatttagttgattttcttatgtctccatcctgtcggcgcaattgggcattaatctagcagaaaccacattttctgtagcgcatgggaagtgccttttaagtcttcaaagggaacatggggagtggggccacactgcgttataaggtggtaggaaataggaacattattccctaaccactacaacacgcaggcagcaagagaaggtgtttatctggtaattacataaagaggatttctcatccagtgattttttttaaagatgttctatacattttttttcatgatctggcttaaaatccttttattcatggtaaatatgatagtgagcaagattactgtcaaaattaaaaaccgttcactccagacatggttccgaggctggcatccctgcgggacagctgcgtgctcagggtcgcccattgtgtgctccctggcttggtgggcacggccacctcctctcacattgtcttacttgggtagaagcgctggtcatggcattcctatgatccttgagaatccttgagaacctgtgcctctatgaagtcatttccacagccagtcgtggggcagccagggcgatgactcagccaataaagggcttggtttgcatgcaagaggacctgagtgtgagtcccagaacctgtatgttaaaagccaagcatggtggtgcacctgtgtgatctcagcactggggaagcaaaacacagcaggtggctttggcttgctggccagccagagtcactcaccgagtaagctctaggccaatgagagaccctgtcttgaaacaaagccaaaaaaccaaggtaaatggcacaggaggaatgatgactaaagttgatctctggccaatgcacacacctacatgctttcacccaccacacgagcatgtatacatacaaggcaaatctctattacatcttaatttctagaataaacgtgtgtggtttgaagagaatggcccccataggttcatatgtttgaacacttggtcctcaattggtggaactgtttgggaaggattagaaggtgtgtccttatcggaggaggtgtgtcaggtgggctttgaggtttcaaaaagacaagctattcccaggatgctctctgcttcctgcttttcaatcaagatatgagctctcagctgttcctgccaccatgacttccccatggcatcacagactctcaccctctgaaaccataagcccaattaaatgctttcttttatacgttgccttggtcgtagtgttttggcacaataatggacaccaataaaacatatgcaaatttttattttaagacacaaagcattatacatttacatgtgtggtagtacacaagcctgagcagcttcacatgttaggttgacacatgtgtgtacttaacaaacatctccccacatcatgagtttgaggatgctgtatgccatagaagaaaattcaagtttctgagatgggcagatcaataagtgtttaaaaacacttgcacccaaactagaggaacctgatttcagatccctagagcacatggaaatgccatgtgggcatggtgacccaggtggcccacctgcaatttcagcctcaaaagatggagacagggaatccccagagcatgcaggctaggaaggagagccacaccagtcagagaccctgcctcaaagaataagggggagagcaatagaggagatccccaacatcagcctcaggcctccacatgcatgtgagcttacacaaatatttttcatatatgtacacaccatacacatgttcccataaagagaagaaaaatagtgaaaaaattcagtttcaggaaataaaagatttgtcccatcaaagcttcaggaaccagtcctcaagtcttggcatgcactagggatagccactgttctcccacagaagcaaaaatactgttagctactacactcgggcaaccaggctttcatcagtctctgtagtggtggtgttcttggtttctctacctgacacagaggtggtttgactggatgaagagaccaaacgtgacccttgccagagagccctgacatgaagctatggcacggacttgtgttcacactgccagggtacctcagctcacaattcatgttcctcactgttggtcccaaatggcatcagataactgcagtcaggacacagccttgctaaaaatagaacacagtgatacccaggtaccacccagggaggctgtcacacaaagcagcagatggtctccctgcagcagtaccgtgtcacgggctctctcgggtgacaaagtacagatattgtgccagcctttgcaagctctgatcctagacaaggctatcaggcaggcacgcagagtgtaatggatagggatcccctagccgacttggaaggcagcgagcgggtacatatgcctgaatgtccctgattcagcatggcaaacgatcctttccagccagtacacagacagccattgtatttattttcctgaggagccagagagttgcttaatgagcagaggttggaagcaggggagcttgctggctgtatgacttgcatgtttaggagaccggacagataagttgctgtgaccacctccttcagcacgggtcccctctctagcatgtagacgagcccaggaatatgtgtatcctggcgacactgtgtgcatcctgagacggctgcaaacaactgagcgtgccttggtgttgtgaaatagagttcatcagtctctcattaccggcatggtgttgggtacctaccctggatgcagccatcacagcacactggggtcccatagaatgggctgtggctggtgtgagtgagagggtaacaggagggtccgtttcatgtggttttgtgggttgacatcatgcaaaatggaaatctaagatcgtcctgcttaatctgatggcatacatcaaaataatttgtttcactttctcctctggtcttatcattaaatgctgcacacacatggagtttgtactgccagacaaatcttcctttcagcgtgcctaatgaatttgttcatcagagtcccctgatgacttgatggcagctcagtgctgggacacttgccttgtgtgtctgtcagtggcgggacacttgtgtgcatgaagccccaggattgagtcccaaagtatgcaaggaaagataaaaggagggaaagggattgagaagagaaagaagaaaagggaggggaaaaggaagacacttctaaaatcagaatactctgttcctgttgtgctaccttaaacagacctctatctagggatacagtcactaaggtaccattattcctggactaatcagtaatcgtatgccatttatatgatcacagacagggtgtacagttgtgtcatcaaatcttcatcaggtctttaaacaaattgaaagtgagttatgaggcgatggggcaagttggggtgaacaaagcttatcctggagaggggaaattgcaccatgggtgataaaatccctgagccccgatggaggatgaatcctgtgggcctggcaggtgttgccatgattccagcagacaagaaagcttctcagccaacaacccgactttcaacacagttaaactgaggttgtcgatggcaccgtgtaggacaaacaaatacatgaattataaaaatattttaaaagggaggaagaaaaactgaaaattaattttaaaattcattttatgtgtatggttgtttccgtctgcatacacgtctacacatcacatgtgtgcctgatgtccatgaggccaggagaggctgtcagattccctggaactggagttacagttggttatcatccaccaaatgagtacctgggaactgaacctgggtcctctggaagattcacaagagctatgtctccaggcctgcaaaatattaaatttttaaagtgtcaattacaatgtctttttttaaaaaaaaatgatgatggtcacacaaaaatggggccaattccagtaaagtctcagtggtagagttgagaaacagacatgtccttgtctgtctggtgaggcttaccggctgaaggacagctcctggagagctgaagaaaatgtgagttccacggggtatgggaagtcttggctgctaacacgggagagaggatccattttccattctgatgataaaatttaaatcctaataaatcctatttgtgaggccactaaagagccctgtcagctttgaagtgggcgtgcattcacagtctgcatacagaagccacaaactgggccaaagcgcagacatctcctagaatctaatttctaagcgtgacactgtggctccaaggtctgaccttccattgctagtcactgtgtgaggacagcctaggacccacacagggctcagacttgtcatctatcttggtgacggccaatggctctctgaggcccctctggggtagcctgaacggtaaaggaggaagtgcagggggattcctgtcatgagcctccttccaaagcagtggtcccaacacgtgaccatgtcaggtctgactgaccgggcagacagccctctttccttaggaagcataaccacaggcagcccttaaaacaatggagacaaaagtagaatcctcccacaccatggcgagtagatttttgaaagtgtagccatgaggaatttgcaaaactggtgaaactatttaagggacatcttgaaatgacagtttttttttttctttttttgagtacaataccaagttagcaggcagaggggtgcggggggggggggcagggtaaatgaagaaccctccgaaagtcccaagttgcaattggcatgggggaaattgcagagcacatgccagggtgagtccttgttcaagtctctgaaaatgtgttaatttcaggatgtcataatcccctgaggaggcagtgacagagtacacctcccactcactgggtactttgccctaaccatatggtgccacatgacatacctacgctgcctgtcccagctccgcctgcttctcctcccaccagaggcatgtgaacgaaggctctcttcccccagcccctgcacgaccccccgccccagcatgttcttaaatcctggtaggagccctgaaagacgggtgctacctatccactgtcagaaacacagtcactgtctcctatcaaacactgcttgagcagcgaaagtgggaatcacagactgcctctccaacactcttagctcggcacaccagacggtcctccgtggctcaccttggttcctgtttgtgtggggcaggcgggggctggaatataggaatatagggaaggagagaaaagcaaggacggaacagcagctcacctgctccgcatgccccgtcagaaagaatgagaaatcacaacatagatatgcacaccgtccttctgtgtgtttgcgtttgtgagcacttgctggcactttgatttttgaggagtaccagcaccatcagttatgtgtaatgcagagaattcagtcctgacaagaaaatgggccacgcacacaagagtaactagcttaatcctcaaagctctggcaggctaatggatttcaaattggccctaactcgccaggcagaatggagaagggatgaaagagactgtagtgagcccataacccaacagcatcttgttcctgttcaagatttaggaggaagacaaatttgagaaagtaaacaccttttcaaggagcagtgcacacatggagaaacccctctgccttgtgggatggtgtctgagctgcaggagctgctgctgtgggcctaggcatcgctgccacttattagttcctacctaagggtcaagtatatgaaacccaagtggtcttagcttaaaaaatggaaagcttgtttgtggagttggaccaaagttggaatcacagagtctatggacaatcagtggacacttccatgtagcatgactgtgaaactgctctgtggcacagcgcgtggctgtaattcctgccttcctgcccacagagcctcatgtctcttgtgactaggcatattaaagtcatgcccagcttgaagtcattattcaaaggcagctttctgcttctggagctacatacaccatccccttcctcccgcctgactggtgctcagtgaagtccagagcttgggtctctcccattatcctacttggactcataacttctcgccttatgacagctgcctgatgtcacctgaggattcgtggttcaccgtgttcaaaccatgaggtctggggactcttgagcccgtctgtcacttcacttgcaacagtggtgcttttctcttcattccatgaggctctgcaaattaattttatgatgggaaatcatagaaacagagttagaaacacagagcccagttcaggatggcaaccaagtgggtctcatgagagccccactaagtgccaccttatagcactgaatctgggcaaaggggtgtccaatggttagttgctactgttgtagtacagagttcattctgtgttgcctctcattagcaacatttgaaagccctctgccaaatttcactgaacctccagcgttcttttcctcctcttcaatactggcatgtgttcctgatcttcaataaatgaacctgtagcataccctgagaaagtagcccaagagactccagttttaatagtctccgtattgtttgtttagaagccagacattttggagctggggactgaatacagggtgggtttcttgctgatcaggcaagcacctggaagctgagccaccttccaactttctgagtctcaccaagttgtccaggttgactttgatctcattctgtagctgggccaggccttgaacttgcaatccttgtacctcagcttctggagtagccaagtatcagtgcccccatcagacatggaaagtcacccagtaaaggcagaggaacaaaagattcccagagacccaacacttggctcagccactcaaccttctatgggcttgggcaaataatcttgacttggtgctgcagacagtggagtgagattgtagcatccctgctctatggaattgaatgtattggccataacatgactaaatgccaaatgctcagaaggcaggtaggatctgttgttctgttatagatggttagaacttctttccctttagcttacaggcaggcaatgtgtcataaatgctaatagctttttaaaaagacaaattctaaatgttgggttggtccaaaccattctcattacttcttagtctcatctgacatgacaaaacatgctctttctgtggtagcaagattgtggtcagttctgaaacaggaggcctgggggcactgagcccttcagtcacatctagaaatggagtgagttcagggattactaccatcatcgccggtgtgtatgtgtgtacatatgcgtgtgcacatacatactcactgggtttgagctctgtgattcagtgttgcttctagtcttaactctgtgtgtttgttcatttgccaggctcagggctatttgaagcaatttgaattagagccttttcttgcattcatagctcataaaatgccaggctggaaaaggtatggacacatctaaggcttctggtttcacagatgagcagcctgagacttggcgagtaagaaacccatttgccccataggatagatggtttgggctgtgaggaagtcaaaactcagatatcccatcttttcaaccggtgcccttccattgcccaaacactagctctgcaatgtcaaatgtgagcaccacacgggtggtctctaagtgacactaacagtgtcaacattaataggtcgcgctgacccaccattattaaaaggacttgtttttactcctgtctattgctcctccagtctcctagacagacaggcgcactgttataaaaattagccaaagcaggaggattatggatggtacatgaacatcccagagaaaaaggtcagttcatctatgagtcttgcattttagatgccctgagaagatctgcatgtcactaagttattaggcggatcaacccgcagcctacgagtctggcagctaatgtacttccctgactttaggctaccctgtggtcacacgtcttcagtctagtgaaatgaggaaatgatttcacgttgactagctagcatcagcctgggaatcgaaaagccatgagcatgaccacaagatgtgccgtgtaaagtgaaatcagaccacggtgttagcaggcaggcacagcactggttagcaggatgaggaagtcgcccaggctaccaacaggcctgcagttagggcttagggtcaggtaacaacctgcctttccctccctcccacagagggaaaaggaaacttccttgcaaaaaaaagtagagagagagggatatctggctgttttgtcacaaactgatttcaatagaaagaagaaacagcatatgcagtatttaaggttgttttcgtgaaaacagcaagctgcattgatttttaaaaatctattttttagtttaattctcctataaaaatttgtgttagttctttgagagttttcctagatatctcaagtaagacatgcagtcctttgcatgtatgccctagacaggtctatcaggataacacggtagacctattatcagcttcttggaggcactccacacttgattccatattggctgcaccactttgcagtcctccagcagagagtaagtgttcccgtgcccaatatccatgccaccatttgtcagcatttgcttttttgattttggcccttttgactgggcttaaatgaaatctcaaagtagttttaatttgtgtttcttgatggctgtggatgttgaatatttttaaatgtttctcagccgtttgcatttttctgaatgtttagctttgtgcatccccatttaaaaatgagcttttcttaatgtttaacttttgagctacttatatactctagatgttaacgctttgtcagatgtatagcaggtaaagactttttttcccacatctacagaccgcctcttaatttgagtaatagtaccctttgctgtatagaaacattttagttttgtgaggttccatttattaattattggtattaaagccttttactatcagggtgctattcagaatgtcttgtcttacaccaatgagctcaagcctatttcccacttgctccccttcagatttggggtatctggtcttgtgctgaagtccttaattcctttggagtagagattttaagggttgagtgatatgggttaagtttcatttgtctactgtggccatccagtctgacaagtagcatttgttgaagatactaagttctctccaatgtgtatttgttggcttttgtcaaacactgggtggatgtaggaatatgggtttatatgtgagtcctcatttccattcatcagtgagtgtcatgctgctttcactggaattttgatagagattgcattaaacctgtgggttggcttttggtagggtggccatttgcacaaatctttcacttctttagttagacttggtctattttatttttcttgaggctattgtggatggtgttatctcctttatttctttctcagtatgtttgttgtttgtgtctatgaagtctactactggttttgttttgttttgttttgtttttttttttttttttgctaatttgctgaattgtcaggtgtaggagtcatccagatcttttacatatagaatcatatctacaaaaatactttgattttcctttcttatttgtgtctactttatcttcctgctctagctaagactcaagcactatgttgaacaggggtgggcagagggaccatcattgcctgtgcccctggttttggcggaaatagagtttttctctgttcagaatgatgttggctgtgggcttcctgtatgttgcctttattatgttgagaccaccccctgtaaccctagcttcaccaggctttttattgtgaatggatgttagattttgtcaaaggccttttctcagctcgggaggtgatcatgtggtttctgtttgtgtggtggattaagtttatcaaaccatccctgcatctctgggatgaagctgatttggccatggtgaacaatctttctgatgtgttcttgaattggctttgtttcacgtctatgttcatcaaagattctgaccttattgtttcggtgtcagaacagtgtggttcataaaaggaattcagaatgttcatccttttctattgggtagttttgtaggatagtttgaggagtgttggtgttagctcttctttgaagttctcatagaattcaacaatgactccctctgacctgtgtcttatagttgggaggcttttaattactgcttctacctcaatgggtgatgtgggttcatttaaatcatttacttcatctttatttaggtcagtcatatatatctagaagttcatccatttcttacattgtaaaggaaggtaaccatacatggactatggatatagatggttaatttattaaggggaaatcatttacacgaggagccgatgacccaaatcggcgctccaagaatccagtctcagcagctttccaaacccatctggaacccagtgagaggcaagtgcccctctcctcccatctttaccctgcaagccccttaggcacctgtggccatgcccaaacaggtgtggtcagcgacacgggtgtgtagaggtctctcctacattacattttccaatttggtggaatgtagatctttaaagtatatttgaaccagtctctggatttcttcaatgtctgttgtagtgtctcccttttcttgtttaatttggatactctctaattcttttggttactttgatgaagggtttatcaaccttgtcactctcttcaagtaactttcttccattgatcctttgtgtttattttcattctatgctgttcatttcagctgtggttttgagtatctcttccaacctatttcttttgttgtgtactcttatttttctaagaataggaaaatgcactgtcaggtgcatcttttagtttagaggcctctcaaagtttttgatgtaagcacataatgctgtaaactttcttcatatggtgactttcattgtgtgctatagattttgccatgatgtgttttcatttttaatagtatttattattcaatttccttcttgattttatttacccaattttgattcagaagggtgttgtttagcatttataactttgtatactttctgtcatttctattattgttgatacccagctttattttagttattagataaaattcagaatgtgatttcaatttccctgtatttattgagacttgcattgtttcctaataggtggtctattttgttaaaaaaaaaaatcccataggctaaaaagagcattatattcattaatttttagataggatgttctatagatgtctgttagttctattgatttatgatgtcattgaactcgagtttccttcttttgctgagtgacctgtatgtccatgagaatggaattgaaatcaccaccatcactgtgttagggttgatctgtggttttatgtttaatagttttcttttgtgaaatttggtgctccaattttagttcatatgtgtttaggattgtaatatcctgttgggtttctcctaaatgagggtaagtattcctatgtatctcttctgattagttttgacttgaagtctgttttgtcaaatattagaatcactatgccgcttgactgttccatttgcttggatactttttcccatacttacactttgaggtggtgtctatcactggtcctggatcctgtttcttggcaacagcaaaaagatggatcctgttttctgatccagtctgatagtctgtttctagttgttgggaaattgagatcaaatgaactttattatcagttaagagacactattgaacaatgtgtgtcaattcctatcattttgttgattttatggtgtctggaattgtttttgtgccctcctacatgtttacccttttcttcagacaggagtgttctttccagtttcttctatagagctggattagtggtcataaattaaatctgatagttttgctgggaacagtcatctacattggcacccactgtctttcatagctcgtaagagtacataggtctagtcccgtctggatttcatagtctccattggaaatttattggtattctaatgggcctacctttgtatgagacttgactttttttcttgtcattgtaaatatcctttgttttgtacatttggttttttgactattatgtgatgtggggaatttcttttctggttccgtattagaccttgataggcatctcatttcttaaattatgtattttcttttccttctatacttattattccataggtttggtctttttttatagagtgagttcccacatgttctgttcttggggtttggggagggatttgacatttcctttagttgagtgatctagttcctcacttcgtcctcaatagttttacctactccaatctattggggaaactttcatgaattcaaacaaattcagaggaatttttcatttcaagctttattccatttggcttctcttcagagatggtatctctttactaaattctgttttcatgtcttgagttgtttttgttatttcatccaactatatttctacagtcttcaatttggcatattcatctcctttgaattctgggatcattttttttctgtttgaatccttatcttgtgtatcatctaagtcatttttctcaggggacattacaatggcagttcaaacttttcattatttatgatgggatctaggcatctggaataaggtcattggtagtgtttgttgtagaaatcttgtcttctgtgtggagggggtggctgaagctctgtgtcctgttatgccagtttgtcagatgatttaccactgacgctgagggctcagtctttggcaattcagtgttgacgttcaagtcgggcatcagaagtaaacttggctcagcttgagctcagtgagatttctaagcccagagaagactttctgtaaagttagaatatgttcatagcccagtttcaggcaacaggtactactggagacggacaagctagtcttgaatccctctgtgaggaatggggtgagcggaggcaggcacagggcatgtcctccttgtgcctatggtgaccctcctgggagagggttagtcttagggtcatgggtatgggtagagatggcagtataaagctagtgcctgcctggagaagaggccaagagggtgcagcagagataggtggggctggaggtgagagtctagactccctgcctagggacaaggcacttgggacaagggatctcagcctttcttaattttaaacactggaaaattacctatatatccatttcagattatggttggttgacagtcaagaagactagccaggaactacccaaagggggtaaaaagagagaatggaatccagaggacaggaacagactctcttttctccctggcacctccttgtctttgttgtctgtgactgcctgtggtttacaaaggacgaggaggcccaggctgggtgctgcttaccattgtctcccagtgcctagcacaggcacaggagtcacaagcgggaattatgaaaggaatgagcaaacaaagagactaatgcagacacagagtggagaatgagagtcccgtggcccgggcagctccagcagagtctgctgagagagagctgccattgtttcctgaaaagcaggcagccttggacatgactgacctagctgggtgcctgcagtgaggacatcctcaccttccctcacttgtggcagtaattgctgtgtctcccgggatcatctgaccctgtgtcacctgatgaacctcaacatttctgcccatggggaactccctttcttccaagtcacatgtgccccgttaccctcctctacccccaccctgcctccatgtctcttctgaccctgctcatgtatgtgtgtgtacgcgtgtgtacagtatatgtgtatagatatgtaagggtttaaatctagctagatttctcatatgatagaaacacaacgtgtttatctttgagcccagattctctcaatagtctcagtgccgcccacgtccctgttctcagacacaaagaacagtgacaccgtcagcctttactttcgtcccctgagctctccctgtcccatctcctctggtggccacctatttcccaccccagaagaagagctgggacattctgagactctgacatggagaaatgatcacttttggcctccgagaaaagggtgcttttccagccaagctctcctctaacagctgggggggggaggtagggatgtcatccttgtacattcatctcagctgttggctgcccaaaggctgcccaaagggaccccagtgactagctggtcactttcagggatacatcctaagaatcaggatgatgttgaggttgctgccttcaccatgttaggtacaggtctgtggcaggaaagtgaaatcatcatcacccccagcttcagttcaaagctcccagccagggcccaggacagggctcactgccaaagctgaagatctgagtttgattcccaggccccacatggcataaggaaaaaactgactctggccatttgtcttctgatctgctactactactacacacacatacctttgatccctaaatacctgcctgtaggtgtggtcagagtaactgaatctgtcactctaaaactcagaggaagtgatgaccctcagtcacttttcctgccactggagacagggaatcgtgtgccccatacacaagaagccatgccaaggaccagtgatgtcaagatgggagtggcagtccaaacacctcgcctcactgcactctggggaaagagagggctctgatggccctgtggttgggaacccaggcagagttttctctggacttacctgggaggggaggagttgtaagcaagaagctccctgcaggggtgacagaggaaggtattcagaagctggcccccacgatctgtggtgcaaagacttccggttcccagctctgacatgggtaattaatctgctggagatgggggttacattacaatttgcagagtaagtgaagactgaaaaatacaggctaagttacgcacactgactctatggtgttcaccagttaggaagagtttctgagacttaggggtgtctatcacaatggtggggaaacacacacatacacacacacaggctgcccagaaaataacagaagtggcaccagctattgccatctggggcaatggcaccactgtaacacactgcttccacagggagcagacagtaggaccccaggccacgcccttccactcccctcctcccccacatggagccgggggccacagaactgataaagaacctcagcagagaacatgggcaggacccaggcatgggcgggcacagttcatgcttttcctatctcctgccccccccacccaacaaacacacactgagatccgatcctgctaccttcagacccatcctccatctctggatgctggcttcatccaggatcacctgggagtctggagaagtcatcgctggggtctttcccagtccatgaggaccaatgctgcctcttcttgcccctggccagaggaggatcctttggtgtatatgctgagagactgagctttgggatttgtttgagacagtgctgctttgtagcccaggctggcctgaaattgacaatatagccatgccggccagtccccgcctcagcttcagagagctaggattacagatgtccaccaccatgcccaagtgagaccacaatgatttagatttcaataataataaatgaccagaaacattctctgtagtgtctctggctccggcccacactcactacccagttcctgcatttcttttaggagaagaatctggactggtttcctcggatgcgggccatgtcacttgtcagcaatgaaggtgacagcgagcaaaacgagatccggaacctgcaggagaagctggagtccaccatgggtctggtgaggcagctatctgggcagctggcagagctgaaggagcaggtcagtgagcttcagtgagctgaggtggggggggggggggccccgggaccccccctgccactgtgagcacggggacccagaaactccaggaaaggaattccccaactgtgctgtgctgcggtggcttctggtggtttctcagcaagcagggactcccccacctcctgtgcagcattctcactggaaagacagggaggggcccatgttgctcttggtgatggatcttatttcctgcctggctttggatttccaagcttgttggaaaggcagacattcactaaaagctgtcactctaaggtcccgatcaacccatttatcacacgatgtcctcagcaaccgtaaaacatgatatcgccaggcccgttggtaagctgttaaatgattccagcaacagattgtgtttcttacaacaccacttcctgtttcctaagcatggatagaggagttggtctttcttctcacttctgtttctggtagtttacttaaaaaaaaaaaatgcttttgcggtgaatatattctgtgtggaaccagacagtggggttcttggggtgaaaaaaaaatcaaggaaagcagctgaaggcacacactttctctctctttctccagatgacagaacaaaggaagaacaagcagaggctgggcttccttggatcaaacacaccccatgtgaaccatcacatgccaccacactgacaccatgggggcacgccgtgaccagcctttcatcagatgcctgcctcgttgctgaaggaaggatgagatggagggagcaaacagtggctattgttgagaagctaaaaacagccaagtgccaagatgctgagccattgagctcccggaacaatccgtaactgtgttttcacgcttgagaagactcaagctaaaaaaaccagcacagggcacagactctcagtgcagcaggaaacaaccaggctgggggggagcagcagactgctcaatcgatgggccttgggctggtctctcacatgctgtctgcaacctggagtccggttagattttatttcttcaaattgtggcacacaggtcagagacgagaagccacactcggctggtggccgagtctgactaagaaaaaaaattttaaagattaaaaaaaaacaagacctgaaaaaggaatctctgttaagcttctgaatcttacatgtaaccggacagtttcttcacgacatgaaatgtgacgggctcagagctctacacgcttggtgtgctttgaaggttcacaccccacacacggaaaacataactggagcagggtcgctttctcccggattctgtgcagggctgcacaaaagggaggtttcatagaactggctaagagtgcgcttaaagtcacgtgaatgccaagatcatgaaagtggagaggcttgaccaggaagcagggttgagcacagatgctattaaaatatactggtattaataaaggaaacactcaaagggacagagaacattgagaaattcctctggtggttttgcctttcacaagcatggagtaaaaagcaagttgatttgtacctgtggtgcctgaggacctgagtgtttgctatccctgcagcggtgggagggaaatctaaggactatattgaatactcaagaatatgcaggctttcaatggctgttacagtaacagtttgtcaaagtgtaggcaggatggaagttccttcccccaaactgtttccatgttgaatcttgggaccagaatttatgtagggagagaatagcctgggtagatacattgtttttggagactatttgaggcgttagagacagagatgaggaaagagtgaaaactgtggtggagggccaccagccatgacactacattctgagcctctcagccaccaagggccacgtggggtttgttacaacaacgtttaaagctttagggggcttcaaggcagctttagctgttggctcctaataaataaaatcctggatctatatggactcactgtgcagctgggaagcctgagtggatccaccttctacttcatgggtctagccttgggacccagtgagaggcactgaatttactcaacctgcacacactaagaccatcctaaaataagacatgctcttggacagagcaggacttctcttagcctgaagttggaggctgctgacacccatgacctaaagtgttgtgagctaattcagtgcagcactgacctttggcccttgtcagggatctgctgcagttacccctaattctttgatagaactttaacgtataattaccaacttttgtctaatggtgccaccaaaattagactgaggcagccatttttaaaaacccaaggctatcaatgctgtgacagtctttgataaaagtccagtacactgggcaagagaaaggggcggaaactgctgtgtggtatgtctgacctaacgtccaagccattacagcagctcactgtctgacactatcttctcctgtgggaaatacccagaagagatttctcctaataagactctcactgtgtcaatttttttcagctgcaatttttctttctttcccctctacaagataaagactataaaatgaaatttttaaagaaaagcaaatgaaacaaaaggcacttttctaggacatggaattcataaagatatttaaaaatgaggaaatctgaagtctggtgagagttttatatttgttatgtgtgtttgttaatgcaaactggattgtttgaagttgagtatacttggtattctcatatgtatatagcaatattaaaaacacagtcacctctgacttctgtgctagggagggtttttcttaatatttaggttattaaaatccatattgattaaaagtcgcagctcccactgaataatatttttaatttacaaaagggtttgctctcctgtgtgttccattctgaggctaaagagtttaatgaaagatgttttctaaattaaaataatcattggggagtagagatcttgcactatctagagagaatattgaccagttgtgtgcatgcaaagatggtatttcctaccctttagaaagttaagttacaaaagggcttattttcctcaatctgccattttttgcctgtggataaagattgcaatttttggtagactattgataatttcagggagctaattcatttgaatcaatgctgatattgtgttgatccccgtatctccaactcacagctcaggcttttgactgtcatttaattaccaactgtaacgtggtatgacccaccctgagactgagtgtgagtaaggaggcctggaggttggtgatgaagactagagaggggacttcacttcccagcatgccatgtaaccgggaaagaagcagctcaccttcagggacccagtcgcttgagtaggtcaacaatgcatggggttgatgacatcacatctcagagcctgtaaccatgcagacagccacactgtggaagagtaaacagaaaatggcacattcctgacagccactttaaagctttgttgaaagattctatcctggagatcccttccaaaatagtgtcagatgcaatacagttatcacctggagggagcgggcatcttcaacccagacacagatggctgtaggagccaggcaaagagctagcaaagctgtgcacatctctgaggctcctgccctgagcaggggtggggaggctatgtaagccaggctaagcttctattttcaaaatttgacagccaattccagatttcagaaaatgctggaggctacccgaggccctgtactcactcctctgctgccgctttgaaataaggattgataggactcctgtgtagaagacgacaccatgctcaaaccaaacagaactgagtgcatgtgaaaacagagctcttgtgatcagctctccgtcacctccctggagtgttcccacagactcaagcagttcgtgaagtgactgtgccagttcttacatcaacaaatggattctctttcctctagcaagagagaatgtctatcttgtcttttaaaaaggtgattttaacatactgtcagggactggataacttattagttaatattaataaaaagaatttgcatctgg

SEQ ID NO: 4 - DNA, 170009 bp, Cricetulus griseus
  misc_feature (17173)..(17916): n is a, c, g, or t
  misc_feature (43565)..(43690): n is a, c, g, or t
  misc_feature (48930)..(50006): n is a, c, g, or t
  misc_feature (65976)..(66033): n is a, c, g, or t
  misc_feature (75729)..(77238): n is a, c, g, or t
  misc_feature (90975)..(91330): n is a, c, g, or t
  misc_feature (120186)..(120287): n is a, c, g, or t
  misc_feature (121615)..(121615): n is a, c, g, or t
  misc_feature (154068)..(154153): n is a, c, g, or t
  misc_feature (165432)..(166655): n is a, c, g, or t
  misc_feature (168338)..(168614): n is a, c, g, or t
atgcaagagagagccaccagcccagaccccagacctaaactcgcttctgctccctgtcacatcctcacttatgaccaaggtgtgagtggagtatatatctcactgaagttaagagtttttttgtttttgtttttgtttttttttgtgtgtgtgttttgaaaacattttctatccttgttttctcaaagaagattgggtgactccccctgtagtgttcatgcctcagttaagaattgtgaggtatgggtggggagatggttcagctctacatagtaccaacataaaaagcagaacatggcttcacacttacctgaaatcccagaatacaggacagtaggcacatgaggatcactggggcttgctggatgttagcctagctccagatccagtgagagatgctgcctcaagggaataaagaggagtggaatagaacagcacatctaatactttttcctaccttccacatgggcatggtgcaggcacactcacagaaatgaatggcatatgccacaaacaaatgaacaaatacataaactcagtgaaacagaattgtattacttgatttctaagcatgcctttgatatgttgtaatattactactactgtgactaatattaataataaaacagtgttcctgacctatttagtaaaactcctccatttctaaatgtctgtgtctatgtggttgaatgagcagtctcaatgggggagagtattagagcagaatattaatagtaactgctcatagatgtaccatcaaatgggccaatcttgtttaattcacttttcagagtttgaagtcctcatagtgaacaatgccacaatgaatgctcacagctaaattagtgagagtgaaaacaagtaagaggaataagctagaactttgtgctgcaaaccatcgcacctcttcgataccatctaggcaccatctctcttcctcttcctcttcctcctcctcattcacctctctatcttcattttgttgcctttttcattcctcctaatctccttcccttcatctttcagtcttgggattattatttctgaaagggctttacgttcactcctgctcttgagtgaaatgtatcccactgatggaattctcagtggatggttcctcctgctctgtaatctgtggctattggctgttgtctttgctgttatttcccctctttctcccagtaacatcgatcgtttgccattcagctcttatactttgcttcccagaatcctctgcctcagaaaatattttcagttcttccatctttcataaattgagtaaaattttcagctacttatgcctccaggaagtgccttactgctgatttggtggtcaaggacatcccaatgtgtatctattagactcactcattggttttttgccaatttgtgtttcttagtttttaacagatgatcttttactgttgtttcaaggatcagttttgcccagtgtgtgtgttcagtgtattacctttgcatttggtggttatgttgtctgctttgttaatgaaaacacccttttggattttcagatttattttcagttttgtttaatatacagttgtgtttgactcatattctttgtacttaattaacatcattgctacctttgtattcccaagcattttaaccattatatacaaatttaggtctgtgtacaaataatatgacttgaggaaaatattctagtgctgtaatgttcctaggcagaagtctggagaatagaatgaatgatcttggatctgcatgagtctgccagcgtcccagaatcctccttacctctcctcttcattccagaaaattgaattttctattcagaagtaaaacatgtgcatctcaaaaaccctctggtatcatataaaagctgtgctaaaagtactaaataaagaagatgaagtcagaaaaataatttatttttcaaaataggggattttttttcaaatcggctttaggaaacaaaaccttttcatatccagttgaccaaagctggatcctacgacaagcacacatacctcactagggaacctggtggtccaggagatcaggagatagcatgtcttagatgacctttaataattgggccaaacctaggttcctgtgctcactgagacatggtgaagaggactatgcccgttggaaagtaatcaacatggcttctaggatgctcatttaaaattcctttttggaagtttctattttgtttgaatttctttcaatatgagattttcccttcactatgagaattttttaaatgtaaatttgtcatatttcttgtctgtgccccatccctttctcatccactctttctatagcagtcatagagctgtctctgtcttgtgttcagaagcaaatattgggttatttttcattagaattaaatttctggggccattgagctagctcagaagttagaagccttcatttccccttacagaaacactgggttcagttcccaggacccacaaccgtctataactccagtttcaggggaacctacaccttcttctggcctctcagggcattggctgcacactgtgcacatatacacatataggcaaaacacttatacaataaaatgtaaagaaaagaaaaagagtgcaatacctttttttgttttgttttgttttttgagacagggtttctttgtgtagctttggagcctatcctggcactggctctggagaccaggctggtcttgagctcacaaaaatccacctgcctctgcctcccaagtgctgggattaaaggcatgcgccaccaacgccctgcctgcaatgcgtttgttagtgcagttactttactaatgagataatttctaagtacctgaagcttcttaagctcttgaagcaatgtacactcttacgtagtttgtagcagttgggggcacacctcacttgctattcttgttttcattcataaatcttaaagccttcttctatccatattttcatgaaatccttaaacactgacctgaaagttaagcagtcagaataaactggttaggaatgcatagacagcctcatcactatgttaaatattaaggaaactttgaagggccctggtgatagtgtagagattcagcggcttgctttgcagctgcagtggaaggctgtgcaggggaacatacatagtggtaccagttagagtactagctaccatatgtgatctgccttgaggacaataatctggtaggattgtggtggtgggagatctttgaaaagcaaggctctgcagttcttaggttctacacagagattaatgagtgacaactccttcttttcctgctcacaccacagtagcactgtcatagggacctgcatttgcctatttgacatgtgcctaaggaagaaactgcttatcctcggctgcactgggccctgatgacattatttattacagatctctaattttattcctttcctgatttccaaattgtgatttcacttcatacttcaagttgttttgacataaggtttgaatcacaagattttaaaagacctgacttgaaactccttaatagggccagtgaatagctgtcattaagaaggtggaatatagcatcatatttcaataggtgtggcatgcaaaatacccctcctgccatcgatgctctcttcacattaaatggctcagataggctgtgcctctctcactgtctttctcccttaaatctgcacatatctcatgtgagagcctggaaatttacttagtgattttatgaaaaccagactttcccccattgtatgtaagaggtctatgaagaaaaatattaaagattttccttatcgttaatgactcacttgctgtgcagactttaaagcttttctggtatttaactgacagcaatctgtatcccataatgtgaatgagattctgcactatgtgatttgttatttactcagtgaaaggaaaatattctcaatgtggtgtgctttgagctgactcttctttagcccttgaatctgtagctataacagcaagatgtttgtagctaagagcttcagtaaatacattcctgttactgcacagcttactctttagtaacttatcccaatcctagacagctttgctaactttgtatatggaaaattcatactttcaagacactagaggaactaccgtatgtataaggcctcccatacttctataatcatcactcaagcatatcacctccagtaaagtttctcttgccttagaataaagaccaaggattgttcatgcctctgtgtagcatcctcctgacaggattccaggacagttatatatgcctgttgagtaccaaagggtgaggaagacacagatttataagaactctgaatcaaaactcctcctctgggttgctcacccacaaaggaggaccccagggaaaaattaagtcaaactcctgtaagggttcaggtcttcaatttgaatgtctgtgttagttaaatatgtgggtagccattcttgtggaagaagagccagggcttaaggtgaatatccaggccagcatacacttctcacacagctttgaagtctgagtagaaaatgcactgatgctgtgtagcatgaagcattagattagccattgtgagtaatgaccatttctgcagcagcatgtctagaccacttccctagagcttctaggtgttgggattttgcacttggaacccatcactgcagtggtcttcttacatgggggattcatggcatcctctacaggatgggaaagctgtctgaagctgctggtgacagagagcatggcctctgcagaacccagttgatgtctctgcatttagtataaccctgacctacttttaaggctatggccacaaagctacatgagatcatagcatttttctggttgtgtctaccagagtatatcacctgtgtatgatattgcaagccaggggatgagcataggctatgtgattcatgtttgtctcaggatgagagtgaagggtcttttggaaggtaatagatggttttaaatctatatgaactcacaatttgcttaatgacaatacaggcgactgcctgtagaaatgtgtataaatatgtttatacttacatattggtgcatagacatagttctctgttgtctaataactgaaaggatttcataacagtgatcataatttgaaccaaaatgaggtttgtaaaagttctgatcttaaaggaacaaaagctgctttaaggtaaacacaggagttaactatctcagtatcaaccattttgtcattccagaagggagatcactcgtaaaaacacaatcataaggatgtgtgtcaaagggacataactggaacatggcagctgaagacaaagctgtatacaaagcttgtcatagtaatactattccactacaaagtggaatagtaatatgaagttgttttgagttataacctgaagtgtggcttcagacatccagacggacataagaacatgtctgaataaataagcaccgatggagaacaaatttctcatgcaaggatttagtttatgtagtgaatctcactagtcaaagaagattggatttctctagagataacagcacagagtggagagcaaagattcagcgactacaccttttcaatttccactagacaatgaaattgaatgtgcatggtaagagtcattttgatagttcatgtgatcatgacagtggtactttatcttcaaaattttcttctcagaatcatgtatagttatttttaggaattatttcattgtctgttatcggtatgcaggtatgagtacacaggtatcaataagtcctgaagaacatagcatgttggatctcctggagctagagttaaaggtgacaatgacctgcccaccatggttgcttggaattaaactctggttctcttcaagatcagagtgttcttaaccattgagtaatctctgtaactctagcacccccagtgtgtgagtgtgtgtgtgagtgtgtgtgtgtgtgtgtgtgtgtgtgtgtgtatgtatgtatgcatgcatgcacacacacacacacattaactacatgcgtgcatgtagttaatgcgcatgggtgttttgcctatctgtgtattgatgtaccatatgcaagtctaataccctgggaaaacataagatgcccttgtatactctggaactggaattacagaatgttttgaggcaccatatgggtgttggggattgaacccgagtcctctggaagtacagccagagttcttaatctcttaatcatttttctatcccttatactcctagtttagagaaagcataagactgatcgtataccaggggcgtactataaccttctgtagcacctctcaactctgtcaaggttatgcaaaacaagggaagagaaagaagttctcaggctagaagtgtctcaagagacatgaacgctaaacataatgtgatactttggaatggaatctggtactgaatatgatgttaggataaagccaaggaatctaaagtacatactttaaacttgttttaaattctcatgttatgtgtatgagtgtttgcctgcatgtatgcctgtgtactgcatgtgtgtagtgcctgtagaggctagaagagggtgttaagtcacccagatctggaattacagatatcaacttttttatttttctttcccatagtggaaaaagcaactgaattatagtgggtaaaaagatattatgttgcagttagtgctctggttatagcaaggtaaatgccatacaaacacctccacattccaggctatttctgtgcaagtggtgttctccacctttcttatgtagagaactgtttagggtgactcaaaaacagacattttctatctcaaggttgagtcattttgtgaccttggtgttcttcctttaaagtcctccagattctgaggcagggtggaataggtggaggccatgtttgagattccaagggctggctctgcatggaattttaattctcacatcccctcacacataaggccccaaaacaatgcccttgaatgatacaagaaaagtagtcagacaattttgccctttctgagaataatatctcttttaactgaccatggatcctgtaactcatcagtaattgacaatgatccacaactaacacaagaggtcagcaaaagatttcacaaaatttcctcacaaggttgttttttgttgggaaataactaaaacaagcctttcagaagatgattgcctctgatgtgtgttcatgaatcatagtctaccaacatttttgttgctgcaatggtaaacctttgtttgattacttgaatttcccagaagtctggcaagggttagccttgtagactgggacatgcacacttacagaagcaagtagcccacggagactttatctggcagcatagggacctgaacagtaagtagcattgatctttccaaggacttgcaataagcctatcattctggaataaaatgaaccagaaattttcatgaagttgacataaagtgccttaccaggataggagccttgtgcatctgccttagattcttaatacattgactggaaaattgaacattcttagactacagtattaaaaaaaaaaaaccttttcactgtcatatattttcataaaaattccagtataagttgatatcacgtgcctatcattgttttctatgtctatcacttttatgtaacaaaatgaattttggccatatatggtggtagatcctgcaatccagacaccctagaagctgaggcaagagaattttgattttgaaaccagcaaactctgcccctatttttttaatagtaaatgaagggaaaataaattagggctttaatagataactgaagtagtccgccaggtttattctgagtagaattccaaaagtatgtttaaaccacttttgaaagtgttcttgagccaaagaaaagccctcactcttcattccacctctcattctcttcttgtgttttgaccatttttcttgtactatttttcaggggaactcccaaaagatgtttttctttttttcatagcaaatgtaagagaaactctgtgcaagactagtgttaaaaaaggaaaagacttctccctgatttctgggggaggattgacggtcttaaacgggaacaagagattggggtttcagctgggtatgaaaatagctatcttcattaagtaaggctaggcaaacagctgtatatttggataataagcagggaaagatatttgaatttcattagtcttttttccttcttcagttagcaaatatctcaccttctaaaattacttcaattgtgattcacccacaataagcatgtaattaaaattgaagaatgtttaccaggtaaggaaagttgctaaaaggagcttggaaaaggctttaaaatatgtggaaagaaggcaaatcaaggagcttgtatacttatgagatatttcaggtgctgtaatgtggggaagattttaaccaagtagacttacaagttaagtcaccagtgttgtcatcattcaatcaactcattcattattgattaataatggaatggcttttgcactgaacttgactggggatgctgtattttgttatattagtctaaagggggccgtcaacaccgcatgagatgcacatgaattttgtgaggactgtggaccacagtggatatgtgtgtttttgatggagcaaaggactgctgccttactctgggggaagtgccctactatcttgatctccttattttttttcatcagagctgggaatgcgaaaagttacagtgaagcacaatgtctcatcatcactggagtatgtgtgctttattgacaccacattatgaacccctaggtccacatgatgtgacacagaatctcttaaaataagtaaaaactgatccgggcagtggtggtgcacacctttaatcccagcacttgggaggcagaggcaggcagatctctgtgagttcgaaaccagcctggtctacaagagctagttccaagacagcctctgaagccacagagaaaccctgccttgaaaaaccaaaataaataaacaaacaaataaataaataaataaataaaataagtaaaaactaagtctagtaagaagggggatcatggtgcaaactgatgtacttggtgagataatccatgcttattttgatgataatgttgaaaagtaggtgctttggtgttgttagatagtaaaactgataggtggatcatctcaagtgatgtatacaaagggttaatattcttaggaaagaccctgctgtcataatggcacccaacaaatacttgtctgatgaatgtgtaaggacaggtgatgtggatttgcagtaattaattgagaattggaaaattagcacttctcacaaaatttaaactaaattttgatatcaggtgtggagaaggtgctgagatggagatctgcagacatttacacacactcagaagaagcctagagtagcagtagagagatcatagactgaatgcctggctgtctatttgctgagcctacaagaagacaatgtgtgtctggaccctatgcatagcagtcttgacaagtggccttcagccaaggtgacagctactgcatgtcttctccaccgattaattgtcagatatctgtgtcccattccaaacagctggggagccatgctgctaggtaatggaaccaccatagattctgtttaccacttggtcatgttttcaatgatttctgaactacatctgtgttctctctggtacagtcagaattgaaagaaggaatgagaattgatatgtgttttgtatgagggacattgggatttaccctctgcttcagcagtggtgtgtgaattgtggaaaggcaaatgtcctggaatagcagcaacctttttctgttcagaaggtcaaataagagatcacttcttcaggtggaattttccataggatggcaagcaaccatctgaggtagccccatgtatttagttctaatagaatgtgtactgagcctaggaataggaagattgttgagagagtaactctcctcagacagggacttcttatcttgtaagaatagcacccaaacaaggatggagccacaactctgtttcaaacgatggaaatggctatttgccatcaaagaaagcattgtgccagagaaatgagtttcttcaaactaaaaacccatgcttcttaattatctcagcaatggctgctcgtgtttctataaaccataaagacacaccatgcaaacaaggattgaagagacttccagagatgtgtgaaaagagctgtcgaagagtagtcctgtgtaagacagctctccccactctcagccctgatttaagcagtgtttgtgagatgattctctgctgtaaatatatttcccaccatgtgtgtcagatcaggcagaatcataaaatgctggctcacttattttgactctggttttcctaacagaggacagtacaagttaagttctttctttatacatatgtgttctaccttgtatatcctggctcctttccattaaatcctcggttctattgtcagtattaaattaaagtctacagtactatattgggcagccaatctttggagcttcaaatggttttggaatttttcacctaagtaagttccagtttaagcttttcatccatggttgaatctaggaccatttactggtcacattttgtaaaaacattaaccgttattgtccaaggttctttatacttatttgtactagaaatatattttcatatctgcatttttgtgctgatcctgtgataaagcccaggggtcatatagtagatagatgatttttttggaaaatgggctgactttctatttttcctattttttgtgagctattttaaaacagaacacctatgatttaaaaccattattgagaaggttcagtggaaaatttttgtattttgacttgtttattcctatctcactgatgtgcatgaacacattatttcaaaatttgtgaattgcttcaattctcaggtaacaattataaacaaatattttctttataaaaaatgtagtgaaaatgtaaatacccatgatttttaaggaaccagaaagaacaagtgacagttctgtttacttattttatctttagcttccaaagttgaagatggaacctagggccttgcacatgctgagcaaacttgttaccagtgagctacacctctagccctaatagttcttgtaaaagtggtttaggtccagggctctttgttccatggatatcatctcattctgccaagaggtcctttaggctgttgttaagatgtttttctcctggtggatttttttctcctgcaacttttggacagcttcaaactcttatttttcttctcactttcagaaggtttgttattaatttccttttcccatccaggtaggtttttgtgatagctttttttcttttttattcctgtctcctaggccacagctttgccttctcctcactttcttttctagtcctcatggccttgttccttcaagagttttctttcagaaatataactgaatagccagactttctatgaaagaaataataaaagccaccgtaacactatcaaccatctcacctgatgcttaagaggcacatatttttttttcctcacaattcattgagaacaaagtcttgacttttgcctgtgttttatgtgaccttcctagttctctagttccatcctttcttgtcttttctgctctacaccagccacatgggctttctggctgtttttcaaatgccccgagaatactctctcttctaaaaattttgtctacaagataaatttctgagtagccttttcatagtaaaatcacaaaaagttaaaatatttaataaaaatgtaaaaataacttaaaaggcagagttccagcttatgctgaaaacatgtttgtgtaactgtacgaggaactcctgtgtgaatgctcttacaagcatctccttttcttccagacattgggaagttggccctcaactgggcatcactttgtatttaatattagaaggacttaagtttgatttgatcaattatttgctttaatttctgagaagctgaacatctggcaccacggttactagcactgcattgtggaagacatattgggagaggaggttcgggggagatgggacacaagatagagagagagagagagagagagagagagagagagagagagaggaagagggagagagagagagtccatgacagacaatgttcaacttggtaatccagtgagtcttgttggggttattaagaagggtaatatgggtgaggggttacttacaaggagtgactatgactcataaaaagcaactgcatctctgtgaagcccacatcatggatgatgactcatgaaaaacagccctggagctctctgcacaactggcaggtagtaatatggtctcatgttctctttgtggtttaaatggccagtgtctcttcccacagccattgtttactcctgtttatactattgggtaggggtcattttgggaacattccaagttactgttatcatggacatgaactttggttttccttctgcttgcatgtttctcctttcctccaggatggagtgttacaatgcaaaggaaactgccctggccctttgcttccagggattaccctactggctgtagtgcgtagttactgtgtctggtggctgagggagaatgtgggaaaagtcaggttatcacatggttcacacaaaaggacattgagaccacaaataatccagaaggtaggataaggaagaataagaagcaggtgctgaaggtatccatgaccggaatgtacccatctcatggtacagagggaaaatagcaggagggaatgctgaaagtggaagctagctctagtcaggtattatgttttgaatcttctgtattttgtgttgctttgatatcttaggaaatttcaatctggtacagactgcccttcctagagctagcttttataacaatgaagagtgtggctgggagtacatgtctcttctactgattagcctgtccacagtgcatattctagccacatcagcctccttctatatgtagttttcccatactaagatactgattttgttagccctatggcatgtcagcaccagacacagagatgctaggtctgtagtcctgagtacactggttgccatggtgctatacacagtgaatgagtttgtatgccttagatatgacatgcagttttggtaaggattgttgttttgagcttgggtcttattttgcaatggcatcactgttgggttagaaggtatggacatttttgttctgtgatagggtgactttcagctgcgtagctatgtaggtatttgtgatgactgagacatacaaaatggacaccaggagaaataaagtggatgatgccacccccagtggatggatatttgctggcatagattatggagagatgaatgtcttctgtaaagggatggatattatgatcagctttggaggaagggtatgatctgtcacaactgtaagtttcttatgtaagaacaaaattacttgttgacagcacacacaaaataagagtagctgcatgctaataaaactttgtattttaaagatacagataccatgctgatgtagtaacttgccaattcttcttactattacacaaagccagtgattttagcccaaagaatgcaaattgacaaatatgtatcaatatgctagtagttagtgtgattcaactacaaataatattgttacaaggcactgtggcttcaatgatagctaatcaaatttcctattgtcttaggagactccatgaactttggctagtatcatgacctctttgacatacatatgtgacacagttacagtattacaagaggaatataatacatacatatattatccaataattatttgtttaaactactctgcatacgctctcaggtctcattaggcaacgtctcaaacctaagttaagagatggaacagggtaaaaaatttctacacatttatcatagaataatgatttcaatctttcttgagctggagtaatccagacccagatttaaattagaccacagaatcaccaatatttgaatgaattatagcacaattctgtttttaaaggtaagaaaggacattgaccagatgttgagatggagtagaagaaagggtttatattgaacagcatattacacttgaattagaattctattgtggaagttattagaggtggtttactttcctctgtttctaagggtttctttcattaaatcatatctcttaaagtgatttatatatttatatgaatgtggttaccaacacatgtatgcaagaggtgcatgcctgttggatccctgagaactagggttacaaaagttgtgagataacatatgggtactgagaatagaacccgggtcctcttcaagagcaacaagtgctcttaaccactgaaccatctctctaaccctgttaattcaaatctttagcaaaaggagaatagaatatgggccaagattcattccttcatctgttgattacagggtgtcactctctcttgttggagaaataggcagtgcctatctctgctaaaaatcctaaatattagttcataagagacacgtgtacttaaaaacattccttgatagtccataaggaacccttcaaataaggctgaggcagtcatatatgtgtccataacatccatgtgtagaaaccatccatgtgtgcatggtatcgttgtgtgcatactatttgatttttagtataacttttgaagataatttatggaaaagcaatttcattgaaataattcaattatctattttaatgttagcaagaatccagagaaccaattggtacttctatgttcaaaaattttctgctgaatgatttcacttaggcaggtgatttgcccatacaatcacatgggtgatgggtagagagagatgtaactgaaacctgattttccagcctctgtatgcgttgtaatctgcttcacagtgtgacagtgacagtcccatactaaaatgtctgcttcaaatatgtcatgtaggaatggctctgaatcaaattctgaaatttcctccctactcactaacccccagagaggatttttttttattttactttgagctcgataagctgacagtattggagttaaacaaatattcttaggtgaacctctgtgtcttatgttactttagagcagcagttctcaacctgtgggttacaaccccttgggtatcaaatgatcctttcttagaggtttcataaaaccattagaaaacacagatatttacattgtgatttataaccatagcaaaattacagttatgaagtagaaacaaaaataatcttatggttggggctcagcaaacatgaggaactgcattaagggggtccagcattaggaaggttgagaactacagctttagaagaattggcctgtggtctattataagtaaatccattcaagtgtttgtgttttgactcttccctttaattcctgatcttggaagtagctgatacccttatgtccataatttctatttagtacaaacaaattaagtacacagtcctgtcgtcatggattccagaattcacgtatggaaaagacaacagaatcagcaattaaaatagtatgtgacttatgcccccttcctgtgggaagtatgatgtacttgtgaacagagataatcctggacaggtcatcaaatgagcagacttgggacatgacaatagatactaaggaaagtaaagaaatagggatggggtttctccacagggctaatgaaaaaaggctcacaggcagggaagattgttgttgggagagctccctgcaggtcactaggtctggcattcaggaagactgaagatgtgatttaaatgaatattgactatagaatctgttctggggagcagctaaaacatcttcaactgcatacttgggcattataggccataacaggcttttaaaatagaacaacatgatataatttgtgagttagggaaactaatcttgctgcagaatagaaagaggaggccggatggataagattgaatatgacaccagcagccacagaatactttcaataaggaaaaaaatgatgaaatctttggttaatgcaggagaatatgggaaaagttagggctgtgatacatatatggacttagaatttgttataggtgatcagctttttggtgtaggaagtgagaaaaagaaatcaaaggcagctgttacatttttagttgattttcataaaaagatgaatctaccctttgatgtgtaatcataagatttggacccagcttgtgggaaaaatgaatttattttaagcacttgaaaacttagccaatggttgaatataggaggctagaatccagacggaagacctgaacctagagagagagctttgggaaatttcaacttcaggtaatttatgaacaggtaggagacaaaccagagactatctgaggagtaggtattagagatgtacagtgatgcagtttgaggtggtaaatttaaggagacagatacacaaatgaggcctcaaagagaactgagtaccatatgctaagaaggtggaggaataccaagagaatatggtgtccttgaaactaaggatagaacaaaattgtcaaaacacttctgtgagggcaaataagatgagaactgaaagggtccctgcatattttgagatagttttatttttatttacataaggaatgtgtaattattacataagtagcatgaacatatatattggtagaaatataaaaccatgtatataatttgtcacccctaattccatcaccctggataactactgttcaaatttgatacatctttccagactttttgtatatgcaaatatatgctctgcatcaaaatatatctatatataacaaaatgagttcatactgtaaaaatacagaatggtgcatgcatttgcttatcatcccctcaagaaatcatgataatctccacaacaatctgactttggtgtatcatctggctactcatatagggcccattaaatcaagccactgggggattatttgtaacattgcaaggctaattttgttagaagggagggcagaaaccagattgtggtgggctggaatatgagtaggcagtgaggaaatggaacagggattacactggctgctcaggaggcagcctatgaagagagagcagagaatgcctaaagtagaaagaggagtgtgctgacagtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtttgtttgtttgttttttcgagacagggtttctctgtgtagctttggagcctatcctggcactcgctctggagaccaggctggcctcgaaatcacatcaatctgcctgcctctgcctcccgagtttgggattaaaggcatgtgccaccaatgcccggctaggtctagccttctttaacaagataaaattttagaaaatgtaaaaatttagctaccttacttaactgttagtattttagaatcacctatttttgagaagcttaagggaaaggtctattttccttcccaaagactcagggtttgtcaagatcttttgggtattttttgagaaatgtactggaaagacacaaattgcgattgaattttattagactttagattagtggctgtaaatatttgagttttagtttttctcattaaaattggagtcctgtcacagaagaccacagaacgtagaggctaatatgtaccattggggtactgctcaggagagaacatgttaccctgcattgctatcttgtgtacatgccagtcaaggagatcctggactcctgttccactctcttgtggaactacagtccacaagactagactttcctaaccagaatttgatgacaacatgtgcaactattagaaagtataataaactttgtcaatgatgagcagtcatcagtataatctctattactgcagaatataaaaatcatgaatttattggaaagtgttaactacctcaaaatgcataaccacaacagactcttacatttcctaaatgcagtggaacagatctagttttgtatttacagaaacagatctcccgaggcatttttaggttcacacactaactaagataaatgctgcagatgaccagaaggaaacttttatttttttttcctcttttaaacacaagaccctcaagattaatagggcaatttggcagtgggtatgcaagcacttctggtgttgaaatatcaatcctcacagtaaaccactgctaaataaatataattgctgtaatgcgttgtgacctttcaaatcctgtcaatcaatgggaagcatcaatgctagccctgttcagaaaaactagttgccatttgttataactagccatgtgtgtaaagaagtgctatgtgtttgtattcagttcagcaagcaagctactttaggccataaagcaggggcattagtcttaaatggtatccctatgagtttctgcaacccaaatccttactaagtcaccagcacaactgtggatttaactttgcctttaaaagtacaatatgagaatccacttgtgcttgcttcaaaatgcaaggtattatgtactaatgcagttttctcataaccactttgatgttcaatatagatcttaattatatatctttgtttttctatgaattatatttatcactactgtattctttcaactttcttccctggagctatttgaaggactttttttatagccttacctgtttgtttttgaacattttactgactggaactcaaaatggcatttattatttgctcattactttcttaagcagtctatacaacagagctccataaagatcttcaaaatgttgaggtctctctgattgactgtcctctgtctgcttcaaatatcctgtttgcctataaggatgggcatcttttgggatgactggccctagccatgcctctctgtgagaacccaattcttgagtggattccacttttattctagtattaattgctctgtctgttgctgagataaaatagctaatgaaagaaacttaaagaaagagcttgtttttgcttagagtgtaagagtacagcccatgatggcaaggaagacatggagacaggagaatgaggtgacatcacgcattgtatttgccattagaaagaggagaacaaatgaagaccagtgcttagcttgcatcttccttcattggtctagaactgcagaccagagtggtatcacccacatcctcccacctcagtccatcctctttagtaacctccttatcacagacatcctcacatttgcctactaggtaattctaactcctctcaaggtgacagggaatatcaaacatcaaagtgtttagagataacaaatcgaagatgaaactatgtgagtataattcaccttgatgtttccagtacctccttgtagggctttgcttgccttgggtagttacgcatatctacgaaatgaattatgtattgatagaggaattaaggaagagtcagaaggctttatatttaaatgatgtgttataggatgggacttatctgcttagaacaagaagtccattggcgttgaaaatcgtatttactcatcaatttacttattcatgaaagtgaaatctaaagtatactattgaatcaaagatctcatatttcttataagaatgttggcattaatttttaactcttatttgtatgtgcctacacacacacacacacacacacacacacacacacacacacacacacactcatgacataatatttacgtaccaactccagggcttaacttggtgtagctgattccctgatacccataacatttttaataaatggccaattctgtgctttccagtgtgaaggggcagaagctgtctcagatgggaatattgggaagagtcagaaaccatgtgctatcatgtggtgaagtaaaagatatatgaccatgtcagaaagtagagtgttggcttggtcataaagagtccttcgacttgttggagaaaagtattaagcaatccaagttccctctaaaggagcatttaggagaattagtttgtttgaattatatagtaaaaccaaagataacagggacagtttggaaagttttctgctgagttctgaaatatgaatgatgtgatttcattgaattgattacattgaaatgaatgtggaaaattaaaaatacaattgctgcacatggaattctaatttatggaaggttagagggacagtggataggttaattcctaaagtagttattctctgattaatttatttgaagttatttttggaccttaaatataatcccacaaaacgttatctagaatgccagtatctctggctttggttgtgtaatctgaatttggattgtgtaatctgaaatttggttgtgtattctgaattgcatgattaggactatgtaaaccttcgtcaatggatttggtttaagaatttctgttacatgtggagtgttggaggcttaacatatcatatagaagtagatgctactatctgtacttcatgtgcatctctagatgaatggaaagaaagctatactacaggaaaatatttgtttgtgtttccaatattaatataaataagattttcattgcaatgagaagccaggaaatgaactagacagacagtggaattcattttcaatttcagattactgactttctattaggatattcaggagtagtaaacttctatgaagttagtaaatcatttccgaatttatgagtacactattataagtctaaacatccactagaaaaccacataagcaaggtaaggacataggtagttctttttaatcgtcaacctctagattataaattattagtattacctttccaactaaaaacttgagagcatgtagcttacttctcctatcttctcccaatgaagttttacttcaagagaagaataaggaggctccaagaaagatacaatagttcaattccttttattttgttttttttctcataaatcattaaggcattgctttagcatgcagttgagctttgacatgaagtgttatatagatttttgaaattactcgaatgttatttttgttttgtagaattcttttagtattttgttaaaccctttgactttgccatcaacaaagaacctgcataaacctgggagggagtgttatacctcactttaacagtagcagattacttgcctcctttccccacaacaaagcaaagaatacctggaaattgcatatgatttcaattttgaatgggcatggtgacagatcctataattgcagcagctacttgcatctcaggttagctttcagttcactgatccagatctttgaatggctattatatagaggaccctgacggtttttatgcaaaggacaccttgttgtcaaagtaaggggatgtgtgtttaaaatgagcagaggttgtggaagaaggtaagcaagatatcactctactctcctgaatatggcctactctagcttagaatgccaggcatcctccctccctcccttccattcagaggtactgtcactggaacacaggtgtctgctaaaggttagcatacatttatctggcttagccacacctacagcaaaaaccttttgaaaaagatacttggatatgaaagtttcttttcgttataaacaaactagaactattacaatattccatataatataattagaaaaccctttttatagtcaccatataagggaagatgttacatcaaaggcaactggaaatgatatgatattgccttaataattcttgaagatggtttctagccaggtgtggaagtctggtctggaaacttgatacaagtacaaattctcaaccccagctaactgtcgtgaatcagaagcactcctcaagggttataataatctgtgtataaatgtttccccaggtgagttttaaggaaaaggcaagtttgaaaaccatttgtgattatttcctctcatgtcaatgaaactgtgccagaaacttggttgcttatagccacctacatttattatctcttattgacagagttaaaaggctcggatgcatttcactggtgtctcttcttagggacttcacagtctcagaatctcataaggtttcaaagtgttgttgagaacagaagacagactggatgggcagctcagggcagaaacccccaacacagcagtttcaaaatgcctccggttctcaggccagaaatgctagaagggagcactgttttcttacctcctaagtgagcaccctgtgtggaggctatatgtgatgctgggcagtaaaattctagttctgatattaaccccttctagtgaacagctttggaatctgggtcttagattttctttttaaagtgggttacatctatgccccagtttcagccatctcttacactatgtgacagttactgcttcagagtggaaaatattacagtaatgtggaatctaccaataggtggagacaagccaatgtctgcttccttaagagttaatccaaatgagcagttcaggcacctgtctaaaggactactgtcaggaatgcagatctacacattaatctatgctaaagctatgggaggaaagttggagaggtggtcagtggtgaagagcattggctgctcttttaaaggatgcaggtttgattctcagcacctacatgatagttcataccacctttatcttcactgccagggagtcctttgacttgtggccccagtgagctagctaaaagcaggcatgtggtaaacagacatacatacaggtaaaacacccatacatataaaaatgaattttaaaagacaggaataataattagttcttcgatgaaacaatgtaatattccttcccaaaatgccccacccacacacccacccacaatattttgtagacactgtgttgcttagctgggtctccttgcctctttgactcctgactcaggaaggggtagtttttcccttttcttctcttcttgtccttttggatactagccagagcttatgcacgtcctgtctctggtagtttgcatttttcggtgtttctctagagctgccctctggcaagaagtgtgcttccttgtccaccatatatctaacttccacactggcttacctcaagggctgttggttttgtttgttttggtttttcttttcttctactaatctccattgtccttctcagaacagctgacaagaattccagattgtctgctgtttgtttgcttgtttgttttgtttttaagcctaataaatttgtcctcaggcttctcttgagtttgttcttaaatcattttattagtgagattacgactcaaagagggcaggcatgtttcttcagtgttatctggcaacgatgaagggagccccaaatctttcacgtagcacaaggtatagtggatgtcaacagctttgcattcttctctagggccacacacaagactcagtgacataaactgtaaattcaagacacttaaggttgacatattatggccatgagctacttctttgactgtgctatgtcttcagtttccctttccacaatgtgtggtagtagcaccaacatcccattaaactatatgattattccctaaattacctacatgttcattatcttcaaaacctatttattatattctttacattaacttatacattttctagtattgcttctggggaaatgctgaaaactttgagaggtgttctcttacatatttttccattaaagtctgagttcttaggctcttgtcttgcaaaatttccagttttgctcttatcccagtacacgaattgatgactaggatcaaattcttataagtactgcaaagaagaaaatacatcacttttgcacccataatgattccgttaattttcagaacaaatccattcccaaccaaatgttactatccttgtttaccaggtgacagccagaatcttaaattaataagctgacttttccaaatatgtgtacagttagttatggtcacatctgtctaataaggatagatattatttgtttttattttcactttaacttacacaccagcagaagctagcctgtcctataaaaagatcttttggaattcactagtgaatggtgatcagaaagacttgatgatttgagactgaggctggaggcatataaatggaaagcaggttggggcaggcacttagataattaggaagcagtgtgattatcaaaagaacattacaatgaaaaaaggggtggggcaggggtttataggcaatttccaggaagattcataaagaggatacctacaaggaatgatgcatatcattaacctacaggacacttgaaagcatgccatggagcagctaaactcaaggtggatttttttttttttttttccggtcaggactccatccttggaaacaaggcacatgaccctctcttcctacagggatctcttctccttttggctttgcagttttcttaatctttatttttctattgtgagtaacaaagaactgctgacctaagcctcttttttaccactatagatattccactttatcaaaaagactaccagatgggctatgtgatcaccatttatggatatgcaactcaatattttaaggagaaaaatcatctcagatatgaaatgtgttgcttggaattttctcttgattttctataactctaatgtggaaaggaaggcagcccatcatcttgcaacttgctttttaaacatttcagagcttatgtccattgtatatggtattgtttcacctgcaacaatgcttaaacgagcatatacattgagcatattcttcccaatatgcctctctaccattccttccttgtccctccctgattctaattagtcctcctttcttcctactcagatacatgtcctatacacatgcacgattttatgcatctatgataaacctagcaaccacacatgaaagaaaatatacgatatttgttactgttctcactctgtatttgaagactccctgggaagtaaaataagattcctgttattcaaatcaataagaaacaaaattacttcctaaacagtcttttgtggacataatatagtgtgttaattatagaattgacactgaaatgatgaaggtgactgagactacaaacttggtgttttcttttgtgcttgaataagataactcactcaaacacaggcagatgatgctggagctctagctcccaaaattttgagatttgatcttgctagatgagtcttttcttgaatatttattgtcctattcctattggtgatgaaaatacatattatattttgggaaaataattactattaataaaaataacgaatgtttctagaaatattggtacacatcttatcccttaaggtccttaacagagaccttgtgaagtacatgtgaccatgatttttacttgaggaatatgaggctaagaaaagacaaatgattggacatttttcccaagctgaatagttgctaggcattaattcaaaaactctatgtgacatcattgtgttagctagctgctgcataatcacccatggcaaagacttgctgatatgtgatgtgtaaaaataactatgatctatctcatcacaatggtttttctgaggttgcctgaccagacttgctatagctaagcatggcagcctggctgggggtatgacttccccagtcctttttctttggttgtcatgggcaaaatgcagcagcacaatgggggatttctagctaggaaacttgactgtagacagttggctgggaagcattcacaatgcaaattccacactagcaaccaggggtggaaggaagaactaaatcttgagaattattttctgacttccacacaggcactgtggcaggcatgtgcctgcaagcacacaaagaggattaattagttaattaattaattaatgaaaacaaaaccccaacgtccagtttacatgaagtcactgggttttgtgattacctattagattatcaatcatggctatcaacatggtgcactgggaagagggaaccacacctgaagaattacctctgtcagactggaatgtgggtgtgtctatggggcattttgtttatttctaattgatagcaggagggctcagttcattataggtactgatatctatagaagagtggacctggattgtataagaaggggagctgactttgagcctggaagccagccagccagcaaccttcctctgtggtttctccttcaggcttttggcttgtgatcctgacttggcagcctttgatggtgaactatgacctgtaagctcacataaaatattcccttcacaaaatgctttttctcaggatgtttttcacaggaacataaaaacaaaatcaggacagatacttcataaatcctgaatgtcccagtaggatgatgtcctcagcaagagtcagccatattgaatatgtcatggagcagatgaccacttgtcaagtcccatgtactaactatacttatgtcttgcaggcatgtttcagcttatagcccttaagtctcatttgccctggacaaagatgatcaacaataagtcataaactcactaccttatggaaacatgatttttatatcaatgttgattacttcattattcatttctccaatgagtactttgtaaatgacagcaatgtaaaaaggttggcggtgtctgcttaattcttctcttctgtgtcttcccctgtgccattagaactccagaagtggaagccaattggtgaacctagaaaactatgggcatgatgactcaactataatttttttatggtttcatgacatgtcaactggccatacattctctcttgaagtgtttcattataagaacagtctatattgtatagaacagtggtactcagaaaaacaaggcaaatatgttcattgtagaaatagtatatctccactattaaaaatgaaaaagacaatcttacctttactggaggctcagtggctggctctgttagatcctcttcagggctagcccaaatggagtctcaaatagtaatattctggacccagctctgtctccacttccaaatgtttccgcccttttgctacctttatagtaaacagtgtaagcatcttggtagtgcagaagttattctgccgagaccctcttgtctagccctttcattatcagactaagaaagagacagtagaccctaaggaactggaatttctccaggactctcctattgggagaagcaataaactgaaacctggtgccagccggtgttcaagtttgactactacaagagatttcatacagtggtgacaacttgtcaaaagagcttgtaggtgagactgaattccagacaatggtgatgggctgaaccacattttgactagaactatttggaagtgcaaatttcttgtccactgtttaaagcctacctctcgtgataacagtctgcaggtggacctgctgtatatgtcactttgttctcagccaccttaccctggtttcacctctcacttttatgcattctctatatttatgtgtttaattcactttttgaggacaggtggttgctcccagcttgttaggacagccagggacaggcatcaactctaactactccagtaacgacaccatgcttaggaaaagcagtattgcagtctcctcttaatgaatttataacatgtcaacttttctcatttttgtgacaatatgacctgtgtagcaaagcaatgattgaggtttatccctaggggaatacgttgagtgatttgacaagcaactcttcttttatgtttagaataagaatatccctgtgaccttcaggactgggttgtgactaactctgcttctcagctcacagaatgctttgagttctgctcaggagcatttatttctcttttctgtttgaagccaggtcagtggatctgaggtgactgtgctagcatttttggttctcaccccagcacttttttttcctgtgtattactttataaagttctatattggaacacccataaaggactctgtgtgccttccttgatctgacaacttatataactagcatggccatcttacaaaggaaaccctctgtttaattggtgtgggttgcatacacatgtacatatgtttgtacacattctggtggaggctcgagagcagctgtgcctggtatttatctcagatgctgaacatcctgtctgtttttaacaagtgtggttattttcatgtgaatgtgaatgcaggtgcattagtaaagatatgtactatacatatgatatgcaagagtctgcaaatgacagagggcctcagattccctagaactgtgcttacaggctgttgaaaaatgcctgctgtaggtgctgtgaactgaattctagtcctctgctagagcagtaacaatctctccctacatcttgtttgtttatggtttgtttgtttgtttgtttttgaggcagtttctcttacttttacctagagctagtcaaagtaactaggttgtctaaccagcaatttcctaagatatacctacttcaacctaccagcttgagataacaaactcaggtcaccttggctgacattttagatggctactttgtatccagcttatcccagcctacgtctttcatgattacttcagcatcatagaaaactgacttcaacacttctggtctggctttctcacggggattttcttatcatcactgctacaccattaagtgtcctattagaatttgaaaaacaattctcatactagtcctccacatgctggacttggtgctaaccactgaactaggatcacttgtgatagtctaaggatacttttgtgtctttaaatcagactatcagactgttgagacaaggaaccccaaagaaatgggaatttccccaggagtttcatgacagtagaaggaaaattaacagtcagagtcttggaaataaatttcacacagttctaacaaattgcctggccaccttaacagaatgagattgaagttcagacaatgatggacaaaagtggatgggcccacaccttgacctggactgcttagaggtggatatctgtggacctctacttacacttttgccccattttagaattcctggatctctttaggagcacaggatctctctgtccctctttctaacatggcctcagtaataaaatcatccctccactcccgggtgtttaattggcttcttgagtacagatggctgaatttggcttcttgtggcagaggctatgacaccaaatttggtaacaatatcagtgcaacaaaaaggtatcaaaacatatgccgggagcttctggcatccttaccactgtacagcaggagaagtcccatgcccagctgcagaataccctgcctgtcagcactgcctgtggcagttgctagtgtgaatggggaaattgtaaagtgtctgcatgtttctttgcaccagcagcatgggagtgccagctattgttgttgtaaaggaacccagttctaaatctgtgtacttggatcgctgtgctcagtttatttagaacatggcatttggagagagataaaataccagcacactgtgcctttgccttttcttattttcttgagcaatttggctgggtctttttgccagacaattagctagttgtgggatataggagggagggatcttgaagaagaatgttatcatgatgcccactgtgatagacctttgtagtgttaatttgagtaggaataatcatctgtattgatttataaggatggaattgagttgtgactttgattcaaagaagaaagcaggcatgaacagtttgatttatggtagtattaaggcaaatatttcagattcagtttctgcagtctaaagttgcctgtctggtgtttacatgtcagaatacattcagcaatttcttgatgagaaatataccccagatggaatctgtaatttatttttgaggccagagttctcagctatattttgtgctgacctcttggagattggagaggaagcaacctgggactcaatcattcatatctgagagtgggttgatttggaaagagatgaataggcttatgagaaactgatggtttataaccatgcagattaccttgattctggatatagtgctgattttcaactatgaaaatttactgcatttataaggtatctttcctacttgagtgatggaaactattgtcctaaagtgtatgatatcctgaagtttcagttaagaagaaaactgccaagtggccttttgaaatgccttggctcatgcaatttgtgaccataacgaatatacttttattcacagtcactctttgtatgtctctccactatggctgtaatgacactttcccaattctccaagttctggttgtgcttttgacaatatttgccacaccaagacataattctctgccttggccatgtttagtttcaaagcataagttgcatgaggtcaagataaaagcctttgtctgaagatggcagatgaatccttactaaacactaaatgaatgacatgtttctgtagtgtcagggtcttgaaatttcttggatgtgggttcaagagggacacggatacacatggttgtgggtaaggatgttattagaagagttattcatgtcatagacaggcaggcacagacaataacatggcaggtgctcggcagagagttgaaggttcagcaccaaagacagacagaatggtaggggctttgcagaagggaatcataacccatgaggcagaagcatggacacatattcatgctgtctaatagaggtggtttcataacaagaaactgaagccagactcttggttcttaagcagcaagcagggaaaggggtgaaaaagtaggatgtttgactaccaacgttccctttgatgtcatctcacttccccaggtattgtagtttatattatttgtcactttgacacacctgagaagagggaatcttaattgcaaatttgtccctaccagatagatccctacttatgcttcgggggcattttcttgatttttaattgatatgaggtagtctaacccactgttggtgttgctgacagggaagtaatcctgagctatatagaaaagatattgaaaactgaatcaggatcaagccaataagcaatattcctctgcggtttctctgtcaaggtcctgccttgcattctcatcttgacttcacttgatgatggatagcatgtaatatggaataaatgtcttcttgctgaagttacctttggtcatagtatttagtcacagcattagaaagtaaactagaacactggataagatatccagtacttggaagcttgtctacctagagactacccagacatggcccaagtaagctacctatcagtatctgggagtgaaagtctgctgccggtattgtgttcttacagatcctacctgtcacgtcttgatatacactggaatgctaaggaatcttccaaaatatctcagttccaagaatttcacaacacagtactggctctggtttctcatccttgatctttcagagttgtacctaaaacaatcttcaagcaccttagaggattgggtgacatactcatttttgaacaccatggtcatagcaaatgtccttgaatgttctttctaatggatattgtatgttcctgcagggagcatgacttcggcaacttcacctatcattttaaaatgggatccaaaaagtttggaaatccggacactcacagtggaaaggctgttggagccactagtgacacaggtaaggggtttgttactatgtatgattccttggtgatttccatgaacctatgaggactgtggaagtcttaaagaggatgcatcatgccatcatgctgattactaagtaaatattatttccccagctgtgaactgtctcattgccttgtatcacttaaagtagcttttgagcaattttttttaaaatgaagttgttgagataattaaagagagggcccttggtgaagagagccctcaattgcaacaccggatggattcattgtctaaatgagccattcctcattcacttgcagattcgaatgcatagggaaaaacttttgactgtttcctagcagtgaatatttatttaatcactttcctctctgtttcctggggcaaacttcatcctattagaattggggggttgcttcatttgggggttggtacatttccacaaggtgaatgtcaagggcacagaatgtcatcaggttttagatgttgacaattaatgtatagtgtctcatgaatcatgtcctcagcgatctgcactcttaagttcctacgatatgaaaatgtgaactttttatgatgcatttgtagagattcattatgccacatgaagcttgaggctatttttattggtttgtgctagatgctttaacaaattaccatcaagttaatggcttcaagcaacatagatttattgtttgatggttttagaggtcagaaaatttaatgtcaaggcattggcagtgctgcactctcattggatacttgagtagaaaatcatgcccttgctttttctagcttctagaagcctcttgccttctggggcctcttccaatatgtttgaggtcagcattatagcatctgtgcatttcttttccttatctctgctttattcatgtatgctctcttagagcgaacctcttaggctctattatgttgagcctactcaaatataccagaaaaatttctacatttgcatttttttaacctaattgtgtctttaaagtccttttgctatttaaggtaacatacttagtttccatgaatagaaggtagctgttttgagaggactggggtgtgtcattcactgtaacgtgacttgattgtgtcctccccatgtgcgaaatattttcattaagtccccaagttactcaaaatctcaaatattatagcatcaattacatttcaaaatctcactctgtattgcctttaaagcctccagtctcatgtgagccctttagggataagtcaagtgaagttgttccacaccagtgagcaaggcatagtcttcgggtaaaagagacagacaatcttagttacagacatcacaattccagaagcaagggagtacaagaataaactttgccagcctcaagtgtagagcttcctctgggcaagtgttactagactctaagtcctgtgagcaaccctctggggcttgagaacctgccccttgagccacttctttttcatggctccctggccatattgttcctgttcatatgtgatcatagtttctggaggtcaaatttgggggacctaatccgcccattgatgtctaccttttaagtccaagcttttaaccatttcaagaatctttagtttaccatttgtacctgtgataattcattccgttgaacaatttcctctagaaagtctttttttcgatattcccatgtgcaggccccagtcacaatggctaaggtaaccccatgtcacacaactagggtttccacatcaccctttacttactgaatactttaaagtgtgtattcatataagggactagcaaacggccatcaggtcatacattagactgcctctcttattaaatgaagaatcttatgttttgggagtggagttgataacgtaataaccctcgaggaatgagatttattagaagaaaggcctttgtatctctgtttgtaatctcttgcatgtttttagtaactagacaggagaaatgaagccattccttcatggctttgcttagaaatatcttcagttaaatatctatgcttatcactgttctagtttcctcataattattctgttactctctaacaaacttttcttttcctctgctttacaacaccgtgcttctgaattctttctgagcccctgctaatgtcatctttgatggttatatttcttaaaagactctttatggtgatttgggtcagtcttcaagatgacaaacattgtctgcaccatgttcctggtgttttgaactatcaccattgggcttttatagacatacttaagaaacaaacacgcaaaacaaagcaaaataacccaaaaccttcaaacaaggaaatcagtgattgcaatatcacatttattcattgtgtgtcagggcatggaagctggaagtcagagggcagcatttgagagttaattctctccttctaccttctggggtctggggatggaactcaggtcatgaccttgctggcaagtagctttacctgtagacctatctcactgatacaagaaggtttattattattgattattattgctaattattattatttatgctcctcatgcttctttcattcattgtcttcctctaatcaatctgaagactacataaaagccctactttccaaagaaaggatctattagtttccagttgctgctgccataatttactactgttttaccctgtagtttaaagactacagatactattacatcacagttctgagatgagaagtcctagtatcagggtgtttgtagggctgcatttcttgaggatttttacaatgtaggctccacattttacatttattaatgtgagggactcatctgttgcctctctttgcctcacctccctccatctccagagccggcagccttgccagccccaaataacgtcctgtgaccaacgttcagaggatctcctctgctgatcttcaatcctcctgcatctattttatgaggttctggtgaccacatgccccaagatgctctaaccatccgcatagctattttcccacttcagttaatatattccctagacccttatgtgtttttgatcaaatatttcctgtgtattttcaacttgtttacgattcctgctggttctttgatcgtatgctgactccctactcagcttgtgttctgtgaatgagagtcagttgatgaaatgttggttagtgggtgacagtcagaacaaagtaaacaatgggacatttttataatcacttgatagagtggttttgtcctttaagtataaacacaaatttggccttgcattttaatttttaatactaaattactcttttcattatgtttaatggaaaggtttttgtgaggtactagaatcagtcgacctattgttcgaggtgtgtgtgtagagggctactttaggagatacctttgaaacaagagaagactggcctcacatgatcctccatgaaagcaagtatacctttttccggccttttaaatgctcccttcattatatacataccggtaatatttagcttatggactaaatgtaatgaagtattaaaacatagtacttagtattatgtaaatggtgaatgaatgtagttttctctttttcctactgttatatatatatatatatatatatatatatatattcattttcatataaaccaataatgagaagtatggcattatgtgatattgtagagaagtaaaattatgtggacttttaattgttaaaaatttcaactttgttttgctctgaacttagtccatctcaaaacatcttctgttggataaaatcagtgattcagaaaggatcatattattatagacactgtttgacattagagggatttagctctgcagctaaccacaatgtccatcaagtacctccaatgtctgcaagctttaacttgcatgctacaagtttgtaaaaatgcttccatacatgctgttgctaagctggattttttttttaatttaatagcatgtagagaaacacactaagctcatgaatgaaccctttaaattcaactgacaggattgctggttcttggggcacttaagaaagacaaaagagacataaaacattaggtgtaaattccataactgatgtttaaagaaaaatgtagaagacagagaaaaaaatgaatcacagcaccagttgtatcaagtgcatgcgtacaacttcatgaataaaatattgttcattggaaaattgaatgccctgggaacacgttttactgcctcacacttttttgagagctttgataatagctgaaacaaacaacaaaaagaagtcagtgtgctcagagtcagttccttcactttaataagaaagatgacattgagaatttgctattgacagacatttaaatattatggtaattgttgcctaatatgaattaacatgtgtatgacatatatttgtctgaaagtgttgtgatggaaagattatttatggagaaattttgcataatttttaaaaattatttatttttttttgtttgcccagacagggtttctctgtggctttggagcctgtcctggaactagctcttgtagaccaggctggtgttggactctcagaggtccacctgcctctgcctcccgagtgctgggaataaaggcatgcaccaccaacacccggctgtaattttgcataatttaaatcctgaaataattgatctagtgaacttctgtcattgtggaagaggcctgaacttgatgtaaatggaaatattgaggagtttagttgactgcattctgtgacaataagtgctattatgaatcaaaaatactttgctcagtaactttatgagaaaaatcatatgtacatgtacacacatatgtacacagggtatgcatctgtattaaagaactctcagatactttttagcaaaattatagataatatgtaacttaatgcgaaacactcatccttcccatccaagtcataaactcccattagtagctacatttactataccatggtagcattaaatgtgtttaatatttttatttgttttgctaactagtattttatctctgtatgttatgtttctgtgcgggtatacctgtgtgcagtgcctgccgaggccataagagggtgtggggtggcttgatgctggagttactggcagttgggaactgcctggtgtgggtggggacaattgaactcgggtcctttgaaagagcaacaagtgctctttcgcaccaagtttcctctccaaatctctccattacttttaagaagatttttttaaagaggcctcaagtttcccctttaaagaattagaataaaaaggatatttaaagacactaaaaaaaaaaaaaacagaatttaatgactgtgaaactagaactgcaagaatagaatacaagagtaaaataactgtgatgagtacaaattctattcttctctaatgtgccaaagaaacctcttctcaagggacagggacaatgaaaagggaggaatgaggagtggactttgggagcccatcccacacggagcctagacgcattggggtgggcctaggcactatcccaaaggatatggcagactytgaagaccgcctatggaaggcctcaccctttctggggagcagaaagtgtatggggataggtaggatgttagttggagggggggcgttgaaggggagaaggggagggaaagggaactgggattgacgtgtaaaacaatcttgtttctaattcaaattttacaaaatggagaaaaaaataaattaaaaaaaagagctgggcgttggtggcgcacacctttaatcccagcactagggaggcagaggcaggtggatctctgtgagttcgaggccagcctggtctccagagctagtgccaggatcggctccaaagctacacagagaaacctgtctcgaaaaaccaaaataaataaataaataaataaataaataaataaataaataaataaaattaagagagaggaaatcaggtgagaaggagagagatgacaggaagcccaggagaactaactccacctgtcactccccattgcagctgccagaacacctgagggaacggaacgtgtgtgttaagtaacatcacagctacccaaagatacccaagagcaggtggaatgctggcgtaaaccatataaacatgggaaatctgtttaaagataggttcctatcaaaaaaagcaccagaacagatggattcctagatgaatattagttgcactttcaatggaaaaaaatgaaagattcatttttattctagagctttatgaaccacgcctaattgcagaagtgaaagtaacattcagaaacaaagcccccctctgactcaaggcatctgtcccatcctccttcccctctataacatactgcctcttcttaacaattaacactatttaataatttatgtataatgtgaccaaaatataacaatataaaaggggtcacattgcttcctcctctgtatccttttccatttatctaaagaatgtaagtattgataagcttctttattcatgatttagtataagaatcacagattaatagatttgggtggtttctatggcaacactacaagttattagcagctgtgcatgcatttctgtcaaagaactgaatggggtatgggatggcagtaacaacatatgatgaggaaggggtctcttcaaggagttctttttgatattttttttgtatagtgtttttttcaacctgttttgaagtatttcacacatttatggttaactgagtattttcttactagattctattttcagttttggatggtgttttcttgttcataaatgctagttttctgcttttatgttgaattgaagttgtatgtgcctgaatcacataaaatcctgtaaggatttttgatacttctataacgtttcttcttaattatatgcatgtataaatataaactaatagcaggacttgaatacaagttacttggccataatttggagagttatctttattacttatattaggattttactgaatgactatgtaaaatttagtgccttacagatagtttcatctctaaatgtcaactgtcaagttgctatgttttcccaggaaatgacaaaaaaatctcaggtcctattgaagttcttgtttgaattgaggtctcagggcagattgtgagacagtcattgataggaattgaattgatgactatgtaatctagagtcagattaatttctgttaggggattgggctcaatattttaatgtgtgccaccagatgggagtgatgctctttcagtaatgtgaccagctgtgttggccctattttgaaacttgattaatacattaagccgttttaaacacacacacacacacacacacacacacacacacacacacgagagagagagagagagagagagagagagagagagagagagattttaaagtaatacactattaaagatgtaaaattatgtaaggcatgtttttctgcaaataatttttgcagaataaatacaatataaaactagtttcaacccagcattaattgcactgatggtatttttcagtgacataatcattgcacatgataaaatgtattagtgtaaccctatctaagttgtttgtttgacatacacacataccaccctgaagtacagtaggagtcctccctctccctactgttagagacagctgctttcaatcacagatatccaaagcactgtggtgtgatttcactgtgcatggcatacatataccctctgttaactggcaccatctgcccattgccttttctaggaaatccagacttaatcagtaaaccattatcatggtttgagacgacaaactaactctcttaatggtgacacaactgaattctcttatactataatatgtatttgcaataatctctggaataggtgcagtcattatattttatgttaatgaaatcatagtaaaagtctcatccctagacaaaaaaatataataactattaactggagagagagagaagatacttaaaccaaaggaaaagatgctgtcagtctgagagtgggggccatgcaaaatgaagggtttagacagaaggtaagcctggaggaggaaaaaggaatgagaaaagcagtgcaattatattttaatttaaatgtatataatttttaaaaagagatcaaaagtatcaagcaatgtgatgtgaatatacttaattaatatatcgcttcacttagtaattcctctactttaactgtgaatgtatttgtgttttgtttttccctctgcttctagaggatcagctgattcaattctgatctccctctttctctctccagctcctcaccccatatattgtaggctatgtgcttctctgtatgtgcatgcatgtgtgtttggccggatgagggtgagaggcagatgctggatgtcttccccagtctgactgactgttcagcaagctccctagagtttggctgaagacaaggtttactgtaacatgtgtgctggggattcaaacctagttcttaatgcttgtaccaccagtactttacaagctgaaccatttccctacctctctatcctgatttctcttacaagtgaagtcctcacagggcctggcccgaggtcagaactaaatgtcctgagtcatttccattagactcttgggcatgttttgaagtctctactgctctgaacttacaaggaactcccctccatgactatgcagctaattcccgaaaaagcagaaaactactcttccagatctcatgaggcttctaggcattgttacttacttaattttctgattcagtaaagtaaatattatatttgcatctggtagcaagacttgaacaatgcaagacctgagcatttagaagaagctcaatattgagctaaaatgggttgtgcggaaacagagctgaaaatactgatgtgctgaggatgtcattcacaggggaggacccacgtgcaagtggaaaggctgggggttaaaattcagagctgagagggaggaaacggagacagaagaacataccacacaataaaagcagtaccaagagtgagactgtaactctcagtgttagagctcttacgtgggaaagacagtctaccttctcttgtttgtgttaattctgataaaagcctgctgcttgctgacatgcatccatttgtaaacacattcctcagcctgcaaatgaacaagttaaattggaaaaaaaatctgtatttttattcaatggttagtgtgtatgaaatgctcagttttgcaaaatctctttcatttggtttaacaatacaatcaagctgttaaaattatttctcttcaggttttttttttaatttgactacttcagtgaatattttcaatgggaaaacagaatttaaatttataagtgaaactcctgtcaaagaagaataatgttttatgtgtttgaaatgagatcattaatgaaattttatgtgatattatccaataatttcaagggacaaattatttgaggttagcaatcaaaatgactctgcttaagatggtacagaaaccttacctgaactaggcataagaaggaagaaaagaaagaaaaggggaatgcctctggaatgcttgcattccaccagaaatacctctactggcaaaccaattaaagcatggcaggtgcctgagctaaaggtgaaagacaagtcagctggactcttttacctatttcagatctgctgctgaaactgtaacatgtacactttgctttcacacacttcaggagagaaacacagtaaaaaaccctggaaaaacaaaccacttattattctgataataaaactctcaattctagtgccactgatatcccagtttggtgggctaccctttttaaagatttatttttttatttgtgttgtatgggtttgtgtgagtgcatgcttgagtgtgtgtgtgtgtgtgtgtgtgtgtgtgtgtgtgtgtgtgtgtgtttgatacctgatccagcaaaagctataaaagtgtgtcagatctcttgaagctggtgctacaagtgcttgtaagctgtctgttacaaatgctgggaccccaactcgggtctattggaaaagtagcaaaccctttagcatccaggccattatccagaccctcttcatggggttcttatcttccccagaggctgtgtctccttcctctttgattaactttgattctctctacacattttatattctagatgtcgggtctttcatcttggaattcctttcctctttctccattttcttccctgtggattctattctccattgcagttttcattgtaacacatatgctgagagcagagttccatttcagcccacctgaaacagctcattagagaggttagctgtgccccactctttctgaaatcatcctggttttcttcaatccttatggcacaggacccattccaaatcatcccatgcctctcttttggtgtccacaactgtcatataaatcatgcagcaacagggtcttctttcctaccatcctgtctctacacgagatgcagattcagcattggcgacaatgaataactttatcatatccctaccctttttaagaagctacacttgttttaggataaagtgaaaatacagtaagtatatcctgagttgagtgcagcattcgtcacccagctcttagtaacctgactcaagcctgagggcccttctgtcaatgtcttggacagtggagacatggctccatctctatatgagaataatatcatttgcttggatcgcccttttagagcaattttgtgctctgatgtcaatgagactgagaacattcctttcccttttctcactttctgtccccctctccctcctttccctgtctcttctttcctattcactccttctgtactccattctcatctctgttcatgtcccctccttttccttcttcccttccttctcaccctcatctttgtttctgaatattgcccccatctgttcttgtcttatggactagaatatggtctctctggcttctgcactggatggacagcttcttgaggataaggatgacatcagtccaattctcacattcatttccactgccagggccatagaaagttgtgggcgattaaataaaatcctctctttaaaatatgcaatacagacatttcgttttgtcttcttcattctgccagaattagcaagcagtaaaaagtggttacatacatactgtagtgcatgtttcatgaagatactggtatttttgcttgtcatgtgatatttaaatgagtgataatggggtaacttttatctgtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatattggtatgggtgtgatggttttgtcctttcacaaaaaagattgatgagtcttttcagaattcctatatataatatgtatcttcattagaaattaagtttatttattactatttttaaacagaagtatgctggggctgaagaggtagcccaggtagcagttgttactcaactctttttttatttttggtttttcaagacagggtttctctaacagtcctggccattctggaactcactttgtagaccaggctggcctcaaactagaagtcacagacatctgtttgcctctactgggattaaaggtgtgcactgccactgccaatctgccctcgttgctctttagaagaccacctttagttcccagaacccacatgtgcctcccagtcatcactcacttgaattccaggagatgtaatggactcttctgacttgtgcaggcaccagacatcaatatagtacacatacatgctttcaggagaaacactcttactcataaaataaaatcagtatcttttaaaaattaaaaggaagtttcctcttccaaaataactgtttgaaggtgtgtatgggctttaaatatgatatttaaaatagtcttcattaaagcttactaaaagactatgaacttcccttttgtcaaactggtatacaaatactaattccatgcacacatattttcactgctcccacccatagtctatgtgtgtatgtgatgtacatgtttgcatcggcttgtggatgagcacgtgcctgagatatcacgttgtcctcattcactcatccaccttactaatgtggcagcctctctctgtcaatctcagagctcactgatctggctaacctttctactttggggatcacctatgtctttcacccgaggtttgtattatagccaagctaccataaacacctgacatacatgtgggttccatggatacagattccgatcctcaagcttgcagataaaggaagggcttgcccattcggcaatgccctgctccattttcacttcggagttatgtggctgggtaaccatatagagcttcccctttctacctcctggacacagcaaccgtgcttacaagtagaaattcaagacagctaaataaagttgactttccaagaaaaaaaaaaagtgtgtcccacaggattatgccacattagagacattcattcttacaatatttttattattatgccagctctaaatgagagttgattttattgataatttgtaaattttaggtatgtttacttttacatttttagcaacgctggaaaggagagccagagataccagtgttttgttttgttttgttttgttttttcccaacaccatattcttgctggagatacaactcaatggtaaaagctggttgggcatgcagatagccatatgtatgaaaacttagtaaagtaaaagtaaatcaagttcaaaggcttttctaacacatttcctaattctgtttggttttctctcttgtgacttctgccatgacttcatgtctcaatcaaaagagcttttgaggtagaactcagaggtgtctaagttcacatgcaggtagggactctgtcctggtccctgacactggctggtgcctgtgtgtcctttaggaatagccatcctcacatgccactgtctctggcattttaaagattcatttttgtttaatggtttattattttgtctgcatgtatgtatgtgtgccatgtgtgtgcctggcatctgtgtagtcctgaagagggcactagattcactgaaactgaagtttaggatggctcaaatcccatcatttggacaatgggcatcaaaccaggttctatgaaagagctgcgagtgctcataactgctaagccatctctccaacctgacatccagttatttttttgacataactttatccatgtttcctgattatcttatgattcctctgtctgatatcattccacactatgtaaatcctagtttgtgcataagtgtgcatatccatgtgtttcactatgttcatttcattgtgcaatgtgtctctagcaagagtgtggattccgttctttttgatttctaccatttagataataattcatttttaaattttttattcctatctatgaatatatgtctatatgggccaatggaagccagaagagaatgccaggcccctgtagctggatttacagatagttgtatgcttgatgtgagtcctgggaatgaactcaggttctctgggagacaatcaaggacttctaacttctgagccatctccccaaacgtacctccttctcttggcataacatgaatgaatggctttaggagtttctgctgaatggaataataagatttgggctgacacagtgagagtctacttctaagaaatgggaaatccctaggctctgttgtcagtgaggcaagactctaagctatgcagagctaacctcatagaacaagccacttgcagtgatttcatggatgatactatgtgttaaaagtgtattttaaaagagtactaagcttagaaagatgtcacctttttcggtcatttcttctgtacagtatgatcccaggacttctgataatgttgctgtgttatttcttcagctctgaatagcaaaaggaataaggtgattgggtttttaaagctttcctgcagcatgtgagttagctataaaaagaaaaaggtgtaaactacttcaatatgatgctattacaaaatatagctattatttcaaatgcacaatggtgcctgtggtaatggctgagatggtaatttcaccctaaactgtagttttcaatggcttatttaacatgaactcccaatttacactgttgactgaaacttctcaagctatattttcatgccctggggaaatttcataaagagatgaaatagaaatctctttagctgtcttattcaagcatagcaaaatataatgttcccacaactattaaaattttggaatattttggtgacatgtacattattaaatgatttccaatgctttctctttcacataggcacattttcccagaaaggacagactgtgtaatttaacacactcttcaaacatttaaaatagttaaacataaagtcttaaatatttgaacatgcaaaatgtttttctttgattcagtaggattctatcagaccactttgtttggatgctattaaaagatgcctaattttacttttctaattgctgctctgtttccacatgcagacattagagttgataattatgccagtggccccttggacatactcatttgtgttctttctatttactcttgtcaccttcagcttttcattattcacttggattctgaaactgctgagggtctggttattgttgtttctgtttgcttcctggaattgttgttgtttttgagaatatcgtaaacctttctgctgtcctgcttgaatgctttcagtcaatgacacgggaagagggaatctcatttgagaaaatgcaactgtcagttgggcccatagacaagtctatgaggcattttcttaattaatgagagatgtgggtggtaccacccatgagcaggtggtcttataaaaaaacagctgagcaagtcatgaggaacaaagcagttagcagcattcttccatggtctttgcttcagttcctgtcccaggttccttccttcagttcctgttccaacttcccttcatggtgggttgtaagttgagagaatgactctttttgttcccacatagattttactcatagtgtttatcagagcaatagaaagcaaactagaaagaaagacttaaaattgatttctctctggatgaaagctgttttttgtcctttgtctacattaaatttagaattcctacatttggaagaacaattggttctcacttaattaatcatcctataggtgttcctaaatgactagaaagtggttgcatgtagctaagacagaaagaagtaaactgctacagggcacagatgtaggtgggaagaatttgttcttgtcctggatttagagcaaaaagggatttcaaagctatctctctcttatctccggtggttttgtaaaacttgcttttttgtttttgcatattttcaggtgtgagtgttgttcgtgaatgggtatatgtgaattggagcattgtgtgtgtgtgtgtgtgtgtgtgtgtgtgtgtgtgtgtgtgtgtgtgtgtgtacattaacttgtatatattgtatgtatgtgtatgtgtgtgtatacatgcatgtatgcttgtgcatagagaccaaagcttgacatcaggagtcatctttgatcattctttcatcttgttcatggaggcacaggcagtcaaatctgcctatactacctacacaggcttgaattataaaggggagtgtgtcacactcactgtatatgcatttttgtgaattcagggagtcttaactctggtcttcttgctggcacatcaagcactttaaccactgagccatctctccagccctccctcagttcttgagtagtgatatatgttcatagtatataattgacattttaatcactttgttgactttgattatggctggattttgtgtatgcatatgcatgaagcttgaaagatgatgtcagcttcaatatagaatgttttaaccatggagaaaaacatggtaaatacatgtacggacacatgcatacataaatagctactgcctcagttagccttaactgtctatttgtaaagccttgaatcaccagcagagtcagtcaaaagtgagtaactatcttgatcaggttgtcttgtgagcaagtttgtgaaggactgcagattatcttaattgcataaggaagatccactccactgtgtactgtttcatttcttaggcaggtggtcctgggctgcatataaagccttttgagcatgagccagtgggctagacagccagcagcatttctccactgtttctgcttgagttcctgctccaacttcccttagtgatccagtgtaacctggttgtgtaagccagataagctttttcttctcagaagttgcttttggtcaactgttttgtcacagaagcaggatgaaaccagagctagaaagaaaaggcctatattctaccgtataccatggtatgacagtcaggttacatgaaggggtttttgaaagtgtgcccctaagtgatgttattccatcaagatgagcctttttttaaaatttgtattaattcaaattaggaacaagcttgcttcacatgtcaatcccttctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattatttgaagatgaaagaacaggttaagactagaaaatttatgatagaaatacagaaatacatataaacttctcaaaacggaattgctgttcactatttctgtcatagtattctgtaacaggaaaatgaatctcacatttgtacattaatagcaagtcattttattactggctgttcatgtagaagtataatctgaatggctactatgtattgagtcatttccagaaaacacttattaactactcagttttacagaattaagcacattcatgaaaactattgagcgagagaatttaattttaaagcatgttttgtagtattttaatgaaccatacattattctgaaatactatagtctttcattccagtttgggaaatcatagagttttattccgcagtttgtttttagccaggctgacttttgaaatatggcaagatatttgaagttagtccattgggtcatttatttcaattacctgtggttttgtttgttttattttttattatttgtttgttttacttgttgttttactttttttctaatcagggtgtttttctagctctggctgtcttggaactcactcggtagacctagaactcctgtttaaaactgctgttagtgtttgtattttattacacttatattttacatgttacatttgtgtgcacgagtacatgtgtacatgtcagaggataacttgtaggagtctgttctttgcttctaccatgtggatgccaggattgaattcagggcatcacttgattctttttaggttgtgtatacttatgggcttttagtttcctcagccagttggttgatatgtcttccctttcttctgtgtaaggttttgtgtattggttgaaaatagactacaaatatctattcatttctgacttttgtctttttgtagccaattatgtatgagcacagtaaaatttcttgacaatagctgtgtgatattttgatatcagttgttgtaatgactccagttttcttttttttaatttgtatttaaattaaaaacaatcttatctttcataccaatcccagttccctctcccttccatcctcacatgcccccaccaactcctcccctccatccactccccagggagggtggggccttccatgggggatcatctaagtctgtcacatcatttggggcagagcctaggccctccccattgtatctaggcggagagagtatcactccattgggaatgagcactgtcttctttttaaaaatcaaagttatttggggagttgttttttttttctttccatatgaatttacagatttttaataaatgtctgtgaaaaataccattggtatttttattttgctttggatatatgtgatctttagtaatatgaatattttaaccatgctaattcttgcagtgcacaaacatgagctattttttcattgtgttttatcctctttagtttccctcagcattgttttattgcagtagctcaaaatcttataaagtaataagcaaattcagttaagtttcaacataaatatatagaacccagtgacatttttgtgaaccaatattgggattccaaaacagaacaaagtccattcaaaatagctaccatgctacaacactaacaaataaattcaaccacggaaatatgcccttaattcttctctttcacactcatttgtgtgagctggtgattttgtatattcagtatatctgagacccctttaatatgtctgccgaactggtaaagtcttttattttttatgcttcttatgagttcatgatggtagctatcatccttcccactttagactttggggcatccttactgacaggctttgaggctgatctggagatgaggaattatctgagtttgcttgtttttacactgtattcatttcttcttcaagtttgaaggataattattttgtaagttttgtgtgtgtgtgtgtgtgtgtgtgtgtgtgtgtgtgtgtgtgtgtgtatgtgtgtaactgtatttgtaaaagtgaatgtgagagtgggtacactcagaggccagaagagggtatcagacaccaggaatctagtgttacaggcagctgtgagctaactgatgggtactgggtccttctttaccactctagcccttgaaaggtaactttttaaatggtatgattgttactcaggaaaatgggaatcagtctacctcaagatccagcaattccactcttaggcatatacccaaaggatgcacattcatacaacaaagacatctgttcaactaagttcgtggcagcattatttataatagccagaacctggaagcaacctagatgcccctcaactgaagaatggatagagaaaatgtggtacatttacacaatggagtacaactcagcagataaaaaacaatgggatcttgaaattcgaaggtaagtggttggaactaaagaaactatcctgagtgaaataacccagacacagaaagaaaaagcatgatatgtactcacacataagtggatattagacatagagaaaaggataaccagcctacaatccacaccaccagagaagctagaaaacaaggaggaacctaagagagaccctttccctgagaaggggaaagggacaagatctcctgaggaaattaggagcatgggggagggggagggaggtaggagaaagaggaagaaagaaaggcagggtggaggagaacatgagggatctggaaggtcaagtttggaggaagaacagaggagagtaagaaaagagataacttaatacagggagccattaagggtttaaggagaaatcttgcagtagggaaatctccagggacccacaggatgaagtcaactaagaatctaagcagtagtggagaagctaccttaaatgcccgtcccctataatgagattgatgactaccttaaatgtcatcacagagccttcatctagtagctgatagaagcagaagcagagacccacagctaagcactgagccaaactcctggaatcgagttgtcaagagggaagagtgatgagcaaaggggtcaagacgatgctggggaaacccacagtatcagctgacctgagtaagtgggagctcagggaccccagtctgacagtttggaaaccattctaggatagaacttgggtcacttgggggtcctgggcagtctatggggcctctgggattggaaacagtatttatctctagtgcaggagagggcccaggttcttccccaaataatgtgacagactttgatgatccccgagggaggcctcatcctccctgaggagttgatgggggtaggacggggcgggggagatgttagtgggcatgggatgatgggagggagagggaactgggattagtacataaaataagattgtttcttatttaaataaaaatcattttaaaagtagtattttcatctttctcctgttttttttttttctgttgcattttgtatattttgtttttctttcttttttttcaataagatttcagctgaactctgctttcaagtctcaagtgacacatatttttcttgctgtttgtagaattctgttttagatctttgaaaattcaactagcatatgccttaaaggtattgtttgggtccttgcaatttctgggtctacaaacttgaatagttttcaatatttggaaacttttcagctgttaatcttttaaataatttttgggatgttcttccttctgttgcccgtctgaaattcccagtttcagatatttgcttacttaatgtcatgccacaattttactcaccttccacccctctttgtcttccccctctcctcttctctgtcctctcctttctaacttatttcaaaatagctgttttcattcttacacattctggtattgagggttcaaccatagtatttattttgttcactgatttccttagttggaggtttctgagactttaaggaaagtttctatgagccctatgagtcggttgcagacatggaattcagcacagtgcctctacatcttctgctgtgatgaatgttggaaacactgtgcatgttccattaacctgaacagcaggagtttgcagggggtctaccttaataagacagctttagcaacagttttaagcaacttgcacccagcagcagagccaaagcatattttaatttcttcagtctccaccgggatgggactgctctggttggctcagctggtttctcagctagtgtggcagcatgaatgaggtacctgttattttctgaattccttagttgggtgttgggtcactctgtggggtctgaacaagactgtgaggcacttctcaataccagagtgtgtgtgtgtgtggggggggctgggatatatcatttggctcaggcaacacacttatcagtagctgaaggctatgtggatgcctttgtaaggacttgtagattgacttgctctgagtggctgacccaccactttcctggtatatatacatgcacatatacaatataccccctccacacatgcagagatacaagtatctagctaaagactatgatttaagaaacttaaacatggtggattaactctgagttcctggatagtctttctgacctggaaaccagttctgactcttgtgttctgattgctagcacaattaggacatgaattttggtctggagatgcttcattttatgttttcatagtactttatcattcacatttcattttctactctcaaacttaatgctgtaaacagaatttctcatgttttatatcacattttaagaattgttatcaatagaatacaaagctgaaaagtcaaatacatggtggtgcagtatgctcctctgctcacacttcagagaggcaagaacttccctgttaaattcctgctgcacagtctgagattgtggtacattgtggtacagtgtgcaagtcagacagacgtcaagagatgcttgctgaaggggtcaagaccaggctggagaaacccacagaaacagctgacctgaacaagggggagctcatggacccccagactgatagctgggaagccagcttaggactgacccataccccctcaatgagaatgtcaatttacctctggtaatctatggggcctctggtagtggatcagtatttatccctagtacatgaatggactttgggagcccactaaacatagagggaaactctctcagcctagacatgcaggggagggcctatgtcctgctccaaatgatatgacagactttgaagatctcccatggaaggccttggaagcaaaaaggggatgggatagggggttggtgggggacaggagaggaggggaaggagagggaactggaattgacatgtaaaacaagcttgtttctaatttatatttttttaaaaagggaaaaaaaaacagatgcttgctggggcctgctgctggtcaagggctcattttattacacatgtattgtattaaaatgcagtagatgtgctctttcctgaggctatatagtaccagtgggtcagccctgaaaactatatacaggtaacactatatagactgaacaggctatatttttgtatttaggaatatgtttctatattcatttatgtatgtaacaataattaatgaacaaaaggccatgaatttgaaatagaacaaagaggggtgtatggaagggattggaagaagcaaaggaaagggggaatgaggtaattatattaaagtcaagaagaaaagaactaatttttaatgcagtaagtagcagacacagagtgaagtggattccttctttggtagagactgtgtataaatgcattctgtcatccagcctggtttcacagtcagcttcttatgtcttttatcccacacactccactggtagagcctgctaataaatgcttttttgccatcttggaaaagaacttttaaaataacaagaatcctgagaataaagaacacagttttgaacttattattattttgatgaagtaagaagcagggaaagaaaattctgaagaatgtaagcaaactggattatattgtaacatctacctttaaaaagatatggattctaacacctcagaacaagcaataagaaagaaatgacatcatgcttgggaaactcctgagttcgttgcatagtgagtgttgaacatattttgacactattctgaaaataaattgcacaggatttccaatataaacagagtaaaagtggactagggcaacatttcaccaaatatttgcagggttaatttctacattattgtcttctagtcactgtgggatgaaatttcatggatcatggaggccagtggattttattatccaagagaagagtgggggttggtaggcagacaagtgctggaaaaaaaaataagttcatggagaatggaagataaacacaatacagacaaattaatttacagctcataagagaaaattggatatatatatatatatatatatatatatatatataaatagctatgttctataacaaaataaaattcttgccaaaaatcaagttttacatgttggtagatatcaaggtcagtagtgttctttctatcccttgatggtgaacagacattttggcctctgcctgtagtctcaaaaggcacagccctttagcagctatccttaagggattccactatcttggtcccaagaacaggtatcgggaaatacatttctacaggaacaaaaacaaaccaaccaaccaaccaaacaacagaaaatatggcctgaattttagaagtcactaattagaggaagatttaagtttgctaatatcaccaaaagacttgatcacttaaactgctttcacagtgttttttactcatgttattgacccaaactggaatcagagatgactcttctgtctctaaaatgaccagactgggaatactttctgggttctgtgtgaaactttcacttgagacaaagcatacccacagcacatggcttcttcaagggctgactttggaataattcaagttacacagactaccatacttttaataatcttgtgcaggacagtagtcagatgtttaaaaatcccaactgagaatttttggtcatttgtttggggttatttatcttgcactagttagaatgaattcctattctatgatgtaaaataggggttgttgtcaattgggatatcaaaacagaggagtttctttacattttacttccagatgaagaaagacatgagtgattagctcagtattttcacagaagcaattgtagtaacaggtatataaacataattgggagtgactcaggctgaaagaaaactagagctctcaattttatgggttaaataattcatgtatcatattaaaaataaaaatcaacccagggcttgctctggtcaatcaagagaggacaaaatttgtatattattgcaaattaaaatgtttattctgttcagaaaagacataggtcaactctggctttgggagctatttagggattaggagctatgtcattgtcctctcgctagtaagaaagcattttggccaccaaatctgatgagctgatacccagacacacatgctaagaggaaagaaccaaccctaagttgtcctttatgctcctcaggaatgccacgggacttgtacatatgcagaaagacacacattagtaaatcagtattatttaaaaaatagagaaaaattgtgacattttctgatcactgaacatctgttatgtgtgtgtttattgtgtgtgttattgtgtgttttagagtgataagtatatcttcttttaaccaaaatactgttacattatataaagcaacatgcttccaatccatggtgcagagtgcattttgtttaacttcaaagaatgaatttgctgttgtttgcaggaagatggatgcagtagagataatcgtattaagtgaattaagacagtttgagaaagccaaagaaagatgaggcacattctctctcatttctgaatcttacattttatatagatacagaaaaccatttgtacatctttaatatgaaagtagaaacaaatattttctaggagaacaaaacagagaaaataaagggaaaactgaaaaggcaagaaaagaggatttatgggggtgaatatattcaaaatgcatagtaccactacattaacatgtccttacaaaacccagtactgtatactgtgaaagtaaaccaattaaaatattatttcaaaatattaaattaaacagtccaaactcagggaaggcaggaaatggacggctctcttgttcagcatgcagtcaatattcagtagaaattttcagaatgaatgattgttcctgattttactttgacatatatagaacataatgtcttttttattatcaaaatttaacttctatcccagtcgttgttctttgggggaaaagaaatatattacaactcaattctacttttcccttctaatgcactggagtaatgtccacattctcaggagtttatatatcaacaaacattggatgtattttcctggcttcaaagtgattttcatgtagaggcttcccaggcttcactggcctggaatgtcccagctgcaagcattgcaagtggattgctgctgagtgacctctttagttttcttttcactgtcagcatcccaggaccattgaagctcattcttcttcttaaagtcttagaaatgaaagagaagatattttaaataaatagttaaacataggtctaaatagaaaatttattaaagagattctgtaactgtgaagaatcctccgaaaacaagaatgaaatacagaaggcagctgcagtttcagtctctgtgggcatctgcggtgggtagatttgggtcgacactagaggcagcaggggcttggagaaggattggctatcactcactctagctctcacatcttacccttgtccagcatgctctggttttctgggtccaattaagagcagctgatatatgggctggagagatgactcagaggttaagagtagtgcctgctcttccagaggtcctgagttcaattcccagcaaccacatggctgttcacaatcatctataatgagatctggtgccctcttctggcctgcagggatgcatgctttccggacactgtatacatcataaataaatcttaaaaagaaaaaaaaaaaagagcagcagatatgagatctaggtttcagtaagccagggtgatatgggtggtataagtatccatagcctgtaaagtatcaccacccaggtaattagctctgagagtgattgctgcaaactagactcttcccctgtcagtgaataattcactaagaatccagctcaggcatcaccaagtggacagtataaatggacatagcagacagtatgagaggtgacccccaattttaagtttgagtacataatcaagactatgaagaaagtgagcactaaggtaaaattaatccacacacaagcacatatttgtattttaaatatgggcaaagatggagagatagatcaatgggcaagtgagctttctgtgatactgcaagcacaagcgtctgaattctagtctccagccccacactgtaaccacagtgaaattgggaccagagatgggaatcactgcagctttttaacctccagtctggtgccaggttcagtgagagactctgcctcaaggggaaaaggtggagacagagcaggtcaccctgtgtccacaggcctctacagtaatgcatggaccttcacatactccattcacactgacagatggatagacagacagcagacagacagacagacagacaccacacacacacacacacacacacacacacacacacacacacacacacacgaggacttcactaattagccctgtgatctttaagaagatctctcatgacttttgtatccttctgtagaaagcatcacgtatgtggcattgtcctaacacatctgatgaatcttcaagcttagagaaggcggggcattacaaataagcctgtctcaccttccacctcggagaagctctctttccacatactaacaatatctaattaaccactgtaacaagctgtcattaaggggtaagtggagtaaatggaagagataatactaaaattaatttttaaaagaaataatcctagtgtgttggacaagaaactcagaagtcattaaaaacatgggagtgataattaaccactaagtgctcgagacaatgagacatctatgctccaaaaagacatccacatgtgcagcgactcactgaggagcagatgaatgcaaaggtaaaattaaaaacataaaagtaaataaataaagcaaccccaaatgaccatatggcttattaatgtgctcgatgcacctcttcctactgtagtgataatggtgctggatttggggatctgggaataaaattctctttataaagccaactataaatgttagcatttgaatctaaaatgatcttaaaaaatcatgtgaaaccatgtctccatcccccatgttgcagtttgcagaggtggggctttgtggtggtgatatgataaaggcttcaaacttttgattggtttaatctctctacggacttatagtttgatagggatggtattccttatgcaaggggatctctctgcacttcctggaatattctatgtcaccacaggcctacaaacaatgaagtcaactgaccttggactgaagcttctgcatcagagagcagaaaaacaaccctgtccttatttcagtttacttctctaggtcttttgtcacagaagtggagaacaaacaaacagaaatagagctttgtctccagaaaccattgcactgtgcagtaactgcatgcaaagcaacagctcttggttggctggattcccacttattaagcatccatttatcacactctagtgtagacaccctcagtcgccttgctgtttccccttacagcccaaatgataggatgtatccctgttctcccagagccctcaccttccctatttctgcttcctgcaggctatggattcatctttgagggaggcactgaattctctgagagttgcttgcttgagtctttcaagacacaagtgtgaccaccttcttcctggcttagtgttgtctgagctaccccaggaaacacaatttctctagggtctttgggttttcttgaaaatatccactggtctctcttcacaatctttgaaaggtcttgtgcaacgagaactgatagctcttgtactctttagactgtgaagcacaccccacagtgttttctgctttatttctactgttgagattttgttctgttttgtcctcttcttttgttcagttttatttatagagagaatgagaggtagagatagggattcatagtatcctataacttacgtggcttactttgcagataattaaggaatggcaatgcagacatataaactaaataatttgggaaatgatgttttgaattataaaacattgttttttgcctttggagtatctgtcgtaatttactttgagcactgtgtttccctggtgtcttaaaatatagtataacctcttttaaaagattggttttacacctagaaaataatgaattggaagaatataacaaaagtgtttgttttcggatgagcacacagtctctaggccatagctggcgaagagaggatgctggtgttgtatgttaatgaaacccccaactgatgtgtcagctgaccttcatccctaatgtttagggtccttcacctctttataatgtccccaagagctttccttccttccaccagtgtcagtgagtcatgatccctgctctagggccttcctctgcctcagtatgcagctgtcacccctttactcagttctaatgtctgtggtcgctgagctatcttcgttggcagttttatttctgctgctggtagcaaatagtgcctaaacttcagagtggatacatgctggctctcccaaaatttaaactcctcccatgtccccaaaactctccatctaaatcaatgtataattgtccagccagtttgttcagttgtatgaaagaaccagcagtaggcaggaagggagagagcatgctgagtcctcattctgggaaagatccatcagatgaccatataacagctgtccgtctcttctcccagccaggattcatctcataaaacatcttcagaccttccatccctggtgtcacatccaagttaattctggaaattggggtgatttctacactaactgctaaaacttggaagtttctccaccatctcaggaccctgcaatattttacaaccaatttggggatggcaataaccagtaagaacagaagagaacatgatgttaaaatgcagttgtcctttggaaactttggttttgctcttcgttgtagagagaccatttattaacatttggcaggcacttttagtgtggaagtttcctggttttgttgttggattaaactagccagcacaagagggaaacagaaaatctcagggatttagagatttatctctcttaggatggctcttcttcatgaatatttataatttagatcctctaaattcctttacactgaagaggctggcttttctggtgatatttttagtttgaggccaatcaacatagtcagttgctggtgtgggtgttcctgctccaccattggcctccaatgaagagatggggcagtcctctcgatggtacatttctagcacattttggctcccacatggaaaagagattacagaaggaaggaaaatcactagggctcatgaggtagctcaatagttaacagcatggactgattttgcagaggaccagtgtttgttttctggcacatatgtcagatagtttcctgattagtgtttttattgttgtgatgaaacactatgaccaaaagcaactgagggaagaaagggtttattttgtgtgtgcttccatggcactggtattcatctaaggaagttagtttaggaacctggaagcaaaaattgttgcagaagccatgaagaagtgcttactagcttgctcctcatggctttcccagcctgccttcttatagaacccaggttcatcatcccagggtggcaacagccacaatggcctgggccctcccttgtcattcactataggcttacctacatcctggatcctatggaggtgcatagttctccaatgtggctccctcttttcacataactaacttgtgtcaagctgacataaaagctagccagtacagttcccaaatacctgtaactccagctatatagaatctcacatacttctgaactcctcagacacctgaagtcacattaattagcacatacccacaaagacaataatattcatgttatacatatatgtgtgtgtgtgtgtgtgtgtgtgtgtgtgtgtgacttaaaatttgcacccacatacacacacagacagacaaagacatagcatgtataaataaagtgaatacaattccttgaatgtattgtcattttattgggattcttacctttttagaaatgggcctttctctccacacccttgtgagtctgaaggagtaggaagaacattgggcatttctgaggccacagagaaggagccatctaacatgccttactgcctcagaagagttccagggaagttgataaaaggacattgctggggacaagctctcctgagtaaattgggagcatggggagagggtggagggaggtaaaaagagaggagaggagaaggggagtggggaacatgagagatcaggaaggtcaagttgggggaagaacacagaggagagcaagaaaagagatatcttgatacagggagtcattatgggcttaatgagaaacccagcactagggaaattcccaggaatccacatggatgaccccaactaagaatctaaacaatattgaagaggccagattaaataatcttcccttattgatgactaccttaaatgccatcctagagccttcatccagtagctgaaggaagcagaagcagagattcacagctaaacactgagctgaactcctgcgatccagttgtagagaaggaggagtgatgagcaaaggggccacgaccatgctgaggaaacccacagaaacagctgacctgagcaagtgggagctcaaggactccagactgacagctggggaaccagcataggacaaaaacagccccccctgaacgtgggtgacagttgggggcttgggaagtctatggggcctctgtcaggggaactagtatctatccctagtgcacaaatgggctttgagtgtccattggagggatactctctcagcctagatacatggggagggcctaggtcctgccccaagtgatgtgacagaccttaatgatcccctaagggaggcctcaccctccctgaggagtggatagtggtgggagcagggaagggaagaagggaggcagagggaactgggattggtatgtaaaataagatttttttaatttaaataacaaaaaagacattgctgaaagtttcccctacaaatgtttttgaaatgtggagacactcttttcttcctcttcctcctcttcctcttccttccccacctagtatatattagttacttttatgattgttattgcaaaactccctggcaggagcaacttaagaaagggagactctcttttggttcaccccttgaaagattcagtctgtcgtaataaggaaggcatggggacaacagcatgagctttcattcacaatggaaaagcagatggctttcttttgatgcagcgtgggatctacatctgtggagtggtgctacccacagccagagtgagcctttccaccttaactgaaatcccctcactgacaaaccctgaggtttgacttgaagttgattctccatcctgtcaagctgacagcattagcctacctacccaggatcaccatgatactctgaaatgagataaactggtatgtaatcagggtttgcaaatgtggtgcactcaattcccttctgaatagctggcctagggcatgtctgagacctcaggttctggaagaacacaacagaagcctggggaattaaattgttctttaaaacaaggtttacttccccagcatctttcacctcaaatactttttattatttttttagagattattgtttgctctctctaagattcaaagtatagtccttgagggcatgccattctgagaacttccaagctttgacgttgctgttgccttccttccttttattagtgggaatgctggatctcatcagcagagcaattgtatacactgttttgggcatgatagggatatatgccttttctgagctctgatttctgtgtcttttccaggaccctgatggcacccacagtgctgacaccttgggttttgtaaaagtcaaatgagataaacacaaagaacaaggtctttaaatgaatgtctatgaataatctgaattcattattcgcaaaacaaagagcttcacacacaaaattctttgcctcaaggctggcaggatggctcagccacggaaggtgctgtaacaaagcctgatgacctgcatttaatctctgggagaaaactgactcccactgattgtcctctgacccccatatttgcatctctactaactaaataaatgtaaaaattctttgcctcaaacttttatttcttgtgaaagcctccccagatgtaattgttattcttttgctagaaatttgagagatggacatggaccatagagagaacattaaccagtttattataggcagaagagcaagagggggctgtagggggcagtaagccacgcctgttagaggctggctacaggtgtgcctgaccaggcctgtcaaggtgtggtcaaggtgaagtcaggatgatgtggcatgggctcttaaggggcctcagagggtatgtaagccccttctcctctccttctccctggcctcgctgctaggctgcccctggcacgctctggcttgcttttggctggtatttatcagaataaaggtatcttgaacctacaagctctcccatgaggggggagagagagaannnnnnnnnnnnnnnnnnnnnnnnnnnnnnnnnnnnnnnnnnnnnnnnnnnnnnnnnncgaccaccagagagagagagaggataataatgctggggggttaaaagggggagctcatgcatgcagccccgtaatgagtgatgtatccatgaaatgaccacacagcacagtgccctttaagctgcctaggtcctgcctgaacctttcagtaatcaaactgtaatctttgttttctcactgaacttgttattatatattatggagtgtatgcaaataagcagacttactatgtgcaggtaacctgtcatgcagaatggaaaaaaatgaatttcttcagaggataagaaaatggatactctgtggaatctcattgtaccataggataattgtttatttagacagttgtatcatatatctgtatgaagctgacctgttctagtggcctattctggggtttcatttgctaataatgcaaataaaaaggcaatcaccattatgccctaaaagactaagttgaagtgaaggagagtgtttgtttaaggggtgaattttgctcaattcttatctacttgctgtttgtcttatgaaataagtttttgttttttaatgataatcttttcaggctgaatatttatagctaagactttgtatggaaactctgaacctaaatttgtttgtatcttgttacattctttggcaagactgaagacataaagcctgagcaaaagacagtaagactttatcatttcaaaactgcccacaaacctcataacataaataaaacatataaaaatgttccaagtatctggatttacaaatgagtcacaaagtacaagggagaaaaatccctgtatagatagattcatatgcaaatcctcctcataccattctattagaaatgcattgaatgatttttacaattgattacaaaccctttgcttctgggtttgggtttttctttgatataagaaagaacagataggaaaatgtattttgtgagttttgatttctgatttgcatctttgtaaattctcctcactgcttctggatgtttctaagcctgaaggaaaaatatgcctgtgtttgacagaaaaaaaaaaaaagtcttttcagcaaacatgaaagtattatattacttgttttaactctcacatacttgttagaagatattatggaaatcatcttgaagagcataaagagcgtgcattgatgtgtaaacatcacactgaagtctctgaaagttggtgacatttgaaatgaccttgtaggctatttgctagttagagattgtgttgttatttcactacattttggtagacaattcagccttgaaatccaataccctttatgcagttcgaccctaaagcacatgtcttatccatctagggaacagccccatcatcccactctaggtactttgctcctggtggtctcttggtccacatggagaaactataattccaagggatttatttatcttcttagatccttgttaaaatagtatggaatattgttgtttttcattatagtgttatgacttcaatctgtagaaattgtagctacacattttgccctgcctcgctttctgcacagcaattagtctttgagatacaacatacgataatttgagggtgtagtataacttaaaagtacatgatactatccacttttacttagaagtggttgtttgtattaagtatagctattccccagagatccttcggcaactggtatatgagcagttttcttcctaaggcgtacaaaagaaaaaaaatcactagtacatattagctacaaaatacttgatcccaaattgctaaatgtctctatttcccagagaccccccttttgccatctcagtttccctcttgtcaatttccatctaatggctaacattacacacaggctacagaggggttgaattacatatagctttcagagattctcactagatctagtgtttagaaaatcaagatgactaaacagacccctgcaaaggaagaaagccacttagatggagttgggggtgaaagaagcaggcttggtaattagaaagcactttgatgtttttcagctgtcactcaatggcccatttccacttggtagaaaacagaaagtggccataagaataaaacctgctgcccctgtgggagtgttacctctcaaagcctcatggcccaggctaatctttcctccataccactcaaggagcaggaagaatctgaaagccttggtcagcaatccagacaggattgaaaactgagcaggatggagtggggacttggagtcaggttgaagagaggattagtgtactgactgaatctggaactgagcacttcaagttaggactactttgaaatagtgaagtaacaatattttcttccttccttccttccttccttccttccttccttccttccttccttccttccttccttccttccttcctttctttttgagacaggctttctctgtgttgacaaccgggtgtcccgggaatcactctgtaaaccaagctggcttcaaactcacagaaatccgcctgcctctgcctccccagtgctgggattgaaggagtgtgccaccaatgcccggctgtaacaacatcttgatggaccatccttggttgtatgtaaacaagataaaagctcatgaaccattagttatgtgtatttcatgcagtatcagttcccttgctttcttctctccccctctggttctctggttttctttcttctctccccctctggttctctggttttctttcttctctccccctctggttccttctgccctccattctttgtttcttttctcccctattcttgccacccctctgtcttgtttgtttgtttgtacaggacaaggtatcatctccatgtaactcaaactagccttggactggatatatactctagaatatcctagtactaactacataaaccccaagactggctttgtgtatgatgaatcagaggcaggcatcaccatgtccagcttctatgccatctttataatatttttcccttctgccatattcttttcttgaataaattatatgatataatgttcaaaataatgtctcatttcaattcattacatgtatagtgcatcctgctaacagttcaggacttgtaacttgaaagaaaaatgagtttattttcattatgattatatatagtcatgaatgataataatgcatgcctaccctgacagtagtgatctagtatattgctttcatacagatttgaggagattgtgaatggtattttgttttcctagtttccttcctccctccctcacttcctccctctttcctttcctccttattccttctttccttcctcctcccctccctcccttccccctccttctttccttcctttctttttgtatacaggaatgctactgattttttttatgtattaactttctatacttctgctttcctgaagatgtttatcagatgtgggagttttctcatggactcttagagtcctttatgtattaaatcgtttcatcttcacatgaagatacttggattcagtcttttcctgtttgtatcctctttatctccttcacttgtctattgctttagctaagacattaaggactctattgaacagagtagggagtgtggacatcattgttttcttcctgattttattgaagatattttgaacaataatacagctgaggactaatggaagttgtgacatgacatgaaatcttttatttgagtctctcatgtttatttatgaagcaaaagttgttagtctgtttactatactatattggattatttgagaagcaaagtgaaaaaataatattgatgatgactctggcagataaaataacttttagataaacttcatgagggaatattaccaacattttattggtccattcttctctttctttatgttattagaaaaacagcgtttgttgcagatagctctaaattctttgcttctctctcccctctgagatgaccttttactttaccatttgagcacagtttcccctgagcaaggggggatgaattcagtgatgactgaaggagaatgagcatgatttccctaaagcacatcactttcctctgtttcctacatattttcagcctgagagtgatatgtttcccaggctgtggccaatgggatgcttaactccctaacttatatatcaacttatatgccattaaaataagaataatctgtctgaccttatgatataagagccaaatgaaagttataaacacaatattcttgaagactggcatctcagtttggctggagtgctttcacatcgagatctgtttatgcggactgactcacatgagatatggtcatttgcttctccttgatgttcctagacctgcggctctcaaccttcctaattctgcagtcctttaatacaattcctcatgttgtggtgacccacaaacataaaattcttgcactgctatttcataactgattttgcagctgttatgaatcattagtaaatatctggaaagtgcagagtactgaacccagcagggagagagcagaatgctgagcacactgggaatgctctgaataccgatcactgcacaaaccccacaggtaagtcaccaaaagtaaaagttgttgtcaagcatatatcaagccgcatgaaattggaagtggctcatgctgatggttaagacttaaagacagagagatgcctggtgttttctttaagtgtttgttatattcctatactttatagcatgttgtccttaacttgaatcatattcctgtgtattttcttaatttcacagctccacaaaagaacaaatactgatatgattaacatctagataagacacgtctaatagacgcttaaaatgacataggaacataccatgagtagcattacactaataaatgggaagaatgaaatggttatacccaatagatatgtccctgttgtcttgagcagcttgtgttgttccttagtcaagcaatataaaaccaaatcatagtgaaacatgccttcaatgagagaaatcaatgtaacccaccctaaggacagcatgtcagtatgatccttgtcttttctgttcacaggcagacttatgttggaataaggaagttcctttgtgaacctgcaattaagagtgttaagtgaataatgctcctggctcacttaggctatcagtggtagtttgctctactaaagttgagattttcaaaatcaaactcgcaaaagtattgttcatgtctcatttcttcatggggcattaggctctaaagcttataagtatgcaaaacagagtttgggttacaatgaacatacaactacagtattgaacagaatcaagaaactagaaaatgtaagttgatgctactgtatttgcatcctgagataacttgtcttcctagaatttagttttatatgcactgctcaaagggcatagactgacattcctgggagctaagtcttcttttttctattttccttgcaacccttttattgttcactgcttcttatgaacaacatgtaaatctaggctggtcttgcagtgtctgtggctaagcagaagagccctgggtagatggaatagctcttactgaaaataattggaatagattatgggatgtggaaacactctaggagtgtattgtgatctagaaaataaaaaaaaaaaatcctcaaatgctaaattgaagggaaacagtcagcctctgtttagatgccacaacctgtctcttcctttagggttcatggcaaacactagtgtatcgtttattgaagaatgtagaacccatactggaactgacttaaaatctaggctatgctttcaaagaagaagtaaatagaaaactactgtaagagtgaattagtcactaagagcaaataaaaatgtctatcatcaggaagtgagaacatcttaactttgacagttttaaagcaaatggagaaaataaagcaaaataaaacaaaatagagggtttccatacaatttttgagttagtactgcatagcctgacaggtaaagtccatgctagctctatgaaccaattccaaatggaaaacatatatatatatattcgagacaggatttctcggtatggctttggagcctctcctggcactcccttgtagagcaggctggcctcaaagtcacagagacccacctgcctttgcctcctgagtgctggtattaaaggcttggccaccacctggcagaaaacataatttttatcaacccaggttgatactgaagtactcattagtagaaaagaattttgtggcagtacgaagcttcatataaggtcttaaataatttctacaggcatatttaagacatgcatgcataaggcaaaaagaatcaataactaccacaagtgtgcactgtaaaagagacaaacacatgggagaatcacaccaatgaaaactgcagatattggtgttatcagacataaaaataaaataataattctggtgctatgttttagaattatgagaagccataaaatgttagcaataaaaagatattaaaaacaaaacataagtaaaattaaaccaaataaatcttagaaattaagtacatatattatgtgcatatataaatcactacatatctacagtgaattaaattaaaaatttaaacaggatgaggtaaatctgcttccaaatgggagaaataaattgtgtcggatgaattttctcaatcaagagtaactaaaatattaatgaaaaagccttagaatatcctcccccaagaaaacattggaagtgcacaaaatctttaaagtactggattcagaaaaatgcaacaatccgagttagacatttccaaattagagcgatcaacttggcaatgtgaaactgaaaagagtcttgggcagcttccttgatctaggagaataaactgaagttcttgagcaaactgcctagtaaacacaagttaaccacagaaacatagaaaaactccaaacgccatgttgtggaataactgagtttgtaacagattctgagatctgtggattcagtgaggttacagcacactttgcttttacagcacacacgtgagctttgaggtctctgctagaagaattcccctaagcctgatgatctgataaaggactcctcacattattctctggcttttatatgcatgtggctaaatgttcacacagacgcatgcacatacacacactttaaataaaatgtttataaaataaagaaatttatggtgttttagtttgtttgtttgtttgttttggtctattttcagaaatctcatgtttggatttatataaccaccaggaggcatgggcagaattacaaaaaaaaatggacataggttgttaaagtcatgtttggattctggaatggctaaaacgtagggccagactccacagaaactgaaatcccaaatcatacttcccagccttttaatataattgatgaagatagtatatccatactatgttattctgtttataaaacacacatttccttgaagaaaatcttatgtgtactatgtactcagaagtcaatatattgtatatgatacagaatcaaatctaataaacattgcaaaaacattggcttaagtaaatataacaacaacaaaacataatccttcaaaggtataaacattgaaattgtcagataggaccagcaagaaactataaattaacacaataatgccttggtatatttatatatgccacagaaatcaaataacaagatggtaaatttaaaaaaaatgaaatttcatatatgagtactgaatttataacaagtcatatgtcttctacactcaaattattgcctcatattctgtaattattactattatttattaagacaatctgttgaatcaatttcatgctggtcttatgtatgtttttaggactgacctcgttatatattataacctgttgcaggtcttgtacctagagaagactgattctccctctcttggtattcagttgatctccatctgacttagctaatcgtatctcaggtcaggctttgatatttcccccaatgaagtgtgcatgtaaacctgtgtgattattattcaggttttgtttagatgactattttttgagatttcataggagcacctttttagttttatgtaaaagacactatctcaccacagacatcctgtggattttacagtttttctacccctcttccaagatgttttctgagccttaattttagccaaaggcaggaaaatgtaataaaaatgttcaggaggactgaaggtggagatccatgatagagtatatggtttcttgcactttaaccccagtgtggaaaaagaacaataacaataaattaaaaaatacatattttagaattgaacattataaaataattcatatgaattgtttggacagcagatcagtgtggtaatatattatttatgatttattaaagcatacatgaatattgagaaagcaaagccagcctcaggctcatagagatcaggcagtggtgatacatacctttaattccaggactcaggagaaaggcagatggatatctgagtccaagaccaacctgggatactggagagtgaactcacacctttaatcccaggatttgagaggtataaaatgtagagccatttggtctgagagttagtttctagccacattgaggagagcatagcagtgtgagtgaatctgaggagcagtgaagttgggagcagtttcaggattgcccccttggtccaggctgaggtaaagataagagctagtggctggctgctttgcttttctgatcttcagcctgaagctttaaacccaatatcagtctttgggtcttttatatattgtgctgtatatcataccaatctagataaagggaagctaattctgcatcaatatagagagaaaaacacagacaaaaatctgaaactatggtaaaagtatcgacatgggccatcacttataacatttagcatatttattcttagagttcctgaaaatgaaaagagaaatatattaggatagtcaatacttaaattgcttaaatctgcaaaatttgaggaatgatactaagtacaaattcaagagtgctggaccctacaaaatagttgcacataggtatttcaaaataaaacatagaagatcacaggtttaaaaaagcacaaagcttgagatcacaatccaatatctaaagatgtttatttattgacttacataatacgttctccaatagtcaaggctggctttgaattaactgtgttgccaaggataacattagatttctgattctgcatcttaggatgacactgaataatctctgctccttcatcttagggtaacattgaaattctgctccttcattctgtggtagcaatgaacttctggtcctcatgccttcatatctggagtactaggatcactggtgggcaacactgtatccatattttaccatactaaatatggaaccaagtaatatcttgcatgctacaccaattcttcaacaattatgtgaaagtccaaacccaaagcattatgtagttgttgatgttttcctttttattactgggcataaaacctggaatctcttgcatacaagggatatgcactctaacaactaaactcttggtgtgtgtgtgtgtgtgtgtgtgtgtgtgtgtgtgtgtgtgtgtgtgtgtgtgtgtgatttttttagagagaaagaaaaaaacatgaagttatgtgtgtagagtggtggtaggatttgggaaagagaaagaatacatatattttattcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccccgagacagggtttctctgtgtagctttggagcctctcctggcacttgctctggagaccaggctggcctggaactcacagagatccgcctacctctgcctctcaagtgctgggattaaaggcatgtgccaccaatgcccggtgcaatccagttttaatatgaaattttcataatgaaaaagtgaaattcaaaatgtgaagatagtgctttctgtacataatggggaattatgaaatgagagaagctagaacaatgcattaattatttttgtagttgttgggagaaattatattgtgatcttttataacattttataagtcttcaacattatataagaacttgacagtagatgttcatgtttctacctgtaaatttccacagcttttgctgtcttggtgttatcattgatcaattggtgtttttgttacctacctaatgatttttcatattatattgcaaagttgttaaattcatagttttgtactcataagaatgattcagaagagaaaaaaaaaactatttcatgattctgagtttgagcagtaagtgaaactaagtctttggatgaccaagattgaatggaatcatgagagaaagcaaagttgtctcccagctgtatgtaggaacttggattgtctcccaggaaagcagttatgcaggggacagtaaaatgttaggctgatgcacaagaataggcagtagtgacctgggattcgtaagagttttcatcacttctattttctccagaaattaaacaaactctaaagagatagccagtaaaaagtgaatttggcaatactagaatcggtttgaagattgacgaagatatgggatactgagaataggataataatttatatttaaagacttcctgatgtttgcagttatgaatgttttcagacagtctgggaagtttgggagaaaaagaatgatatcataacttcagacactgcaactcagagtttgtgcacacacatataaatggattaataataatcaatttgggggaattttgcttaaagacataggtaagcacttctgccaacctagacaacctcacagccataaactcactttcttgcattgctgtctgattgtctcatctaagttaggaatattaaatgaaaatgatatcaatttttagaaagacacgaaatgcccatcatctaggaaatcccatttatagtatttatttaagctaaataaagttcaaaaactcaaaaaaaaatcatttgtaatgtccaacaaagaaaacacagagtgggaaagggaacattcatccatgtggttctctgaccttgcttgtctgggaggcattttgattatcatcatgttacctccattggtcttcagaaatgttaaacgaaacactgttttagaagaaattggttttatctgaggcagaataaggaatattaggctctcttcttgaacagctatttgaaattcatggaatagcccacaaaaccttttatttatgtctcagtttttttcactttcattggaaaaagatttcatatgtgaacagggaatgtcgggaagtatgagctactcagccatcgtgtgtgtgtgtgtgtgtgtgtgtgtgtgtgtgtgtgtgtgtgtgtgtgtgtgtgttgtgtgtgtgtgtgtgtgtatcattctgtgtgtgtgctcatgagtatgcgcatgtatgtgactatgtgtgtgtatgagtatggtgtgtgtgtgtgtgtatctttgtatatagaaacaccgatgttgatgattctgcaatgttatattggctgataaaatcttcattattagtatatttggaatgttgcttaaattatgctgagtctaaattatctttacctagttttaatattgagtcattcattgtcagtttctgtatcatatctaactttgtgtttaccatcagagaagacctttgtaaattatccatagaccacacctgaggcaaatatttctcatttaccagatatagccttatattgctttggaaaatgtctcaatttgtagttgtttttggttctgtgactgtagaatattcctagagccactctccatttggaatataccattgtgggcaaattagacacatgttcctaggcatagctcctgtacttgaatcaatgttagttgtctcttagtctctttgaggtacagtgtatgttttgcatgcccaaattaacaaatcatcaggctgaaaacttattttgtactcttttgtcagggtgatgaactacttgagtggtatatgctaatgacgacttttcaggaagattctctgtttctcttctgtatagatttagatgttattgttccaaattctatcatgtgcccacgggggggggggaagtaatagaaagcagagaccaaatgattttcactgcagtttcttctagctataagaactgagttaacaatagaaagtgcttgtttgaatcctgtagttgttcacaacaaactcaaggaagaaaaacccaagtcacctgttgttagaggaacacaaccgactttacagacatatatgaagcagcatcatttagcagaatctctagggccttatttagctcagtcttacttattttagtaatcttggcaaagaaaagttggtctttttacattgtttttttaaaatcacaactgaaatagtgtcaagcacactttgaattttaacaaattctatattctattatattttgaaggtcatggattcatttgcattcatagacaagtacttcagcttaggacagagttttttatcttgaatatactttatgtattcagcaccccactgtgccatttaaaataatcctagaatcaaatgtgaatcattgccatgttctgtcaaaagtcatgtgctctataccttcatgttggcccatcagtagattatttcagctaaataaaaataggcagtatgcaatgaagctcagatttccttacagtaagacactttaaagatcctaattactacctcataagtaatttcattttgaagaatatggatttcaaaattataggcacagagatctgagattgttgattacaaacccatatttttataaatgaggaaatttgtgagtcagggtgaattggattgcccaagtttatgtgcccaataagttaagcggttagcatttctagattgtgggatatatactgagaatgcattacaatgattaccagttagcaaatatcatgggaaatctaatcttaaaaatccagaatcactcaaatggtagagtaagtgtgaaaatctttctcccacagtcttgaaatgcctgtccctgctagactttgtacagacggtctccagcttgtcgttgctgcttaaaagcccctgtaaatgaatctgtggtgcagctccatttcctgtgtattatcctcctacgtgttcctcctgaagctgcctgcagttctgacaccctgtcaacacaacccatcaagctctgtgtcttgcagttttctagctatggagctgataacttgcaactagaaattatgtatctgagttgtctttccaaatgtgttgcaaaggaaacccaggtaatcgttaaatgcttgattgaagttttcctcacattgctattatccgtcactgcatttatagtttcccagatgtcacttgggccagacatgacgtcattggcaagtatttctccaattcctcaagtgtatttgaaactttgtcaatactaaaccattgctatggttcctgaaataggttctttcattcctctatgacataactattgaagaattaattccttctgtactgttatataaatttacaaactgacaacacatatttttagaattcaacagctaactttcttcagaactttagtgtaccttagtagttgaaacaggtaaaaataatagagaagtgcactgtagagatttgtaaacagggttaaccacaaatttggtctactctccatagtaaacactgtattaattgaaatggtacaactgtgtgaacaaatattgccgagaatttgcccttccctgtgaattttcttagaagatgttatggtttttactgaattataatcatgtgtgtgcatttgtgtgtgtgtttataagactcaagtgatcacattttagactttaagtactatgttgcttatggaagatgtatttgggtaactttccgttttatatatggctcatagattatacatttgtttcatgcctctggtcaaaggccttagggtggtttgagtgagaagcctcccatagacagacctgagtatttcaacacttgatgctgatgtcactatttgaggaagtttaggactttctggagaaaccattgcactgtagtcaggcattgagagtttaaagcctcttgccacttccagttcaccctctgtttggagcttgtggttaaaagatgtgagctcacagcttcctaatcatgctgccatgatagattcttacccttctggaactgggagcccaaggcttggtcatggcagtttgccaggacagaaaagtaactaatatagaccttgacaacttggaattgttgacatcttcttaggatgtagcaattggctccaaaatctgtaactctctctagttccacatttaaacactaaattggaagtgaacagtaatggggctggactgtaaaggaaaggaattgaacttggctcactacactctttcattatttgccatccttagagttgtgcttgtttttaaaacttcaaatgacaggtgtgttgcaggatgcactttcattgagtaaaaaaaattactttataataaccatgctacaaaattattacttggctcaggggtgtgactgtcatttaggcaatacttggaagcagttcttcctagaatactagtgaaacaatgtttacatatttttctcttttagaatggttgcagaaaccagagagttgaataccaaatttttttttttttttgtgtgtgtgtgtgtgtgtgtgtgtgtgtgtgtggtgttgaggtaactgaagtttgtcctatactttggccctgataaacatgattcccatattggagtcaggaagctaaggtcagccatactcagtgacgttcctgatgatgtgtgctatggcagtgcagtggtgaaaggcagttgacaactgggctgtccaatttgctgaatttatcaacagccaataaaaagcctctaattctatttctgtcttgctatgtatctaaactcagcagtaaataggaacttttttaactacatattttcttcacttactggaagactaggattttccatagcaactcaaattttgtgtgagaacatatactaatcatatgtgttagaacattggtgacaaagtagttctaatgccttgcttactaaaattacatacagtgataaaacaaattatgaatgaaaataaaaaatatatactcaggaatgctagtgaagagaaatagagctcactgttgactttcactagtaactggaagctatttcacttttctgcttctgttcttaatggataagaatgataaaaacacgtaaaaggaatgaagtatacacatagacaatttgataattatggtagtatgtggtagaagtttaatagatattaacttgcagccatgaacatcaaacctattttctttaaggataaaatatttgtataaagatttgttcttacagcatatgtattagaaagtgggtgtttccatactgaatcaagttagacactaataagattgctcagcaatgaaagcacttgttgcagaactgctgatctgagtttgatccttcaagcccgagtgttagaagtggagcaatgaaaacaatttatcctgatgtccacatactttttgtggtataagaatactctgatttgcatagttatatatgtatgcacacagaatagtaaaatgtaatataaatataagctagaaagtatcttttaaaaattttgttcatcaaccctttttatatttgtaatattaaaacatgccctggtggttaatattttatcaggaatggatgacacttgttttatctttttaaattgactaaaacaatatgaaccataagagaaagaacaggaaatattccccagtgatgcaatagttatttatacatatatttttttattcattaagtatataggaacacctatgtatatatacgaatatatatgagatgacatgaaattacacaagcacatacaattatacaagtacacacatatatgtacatatacccatcatatatataaaatcacaggacatacgaggaagagagtgatattgcacatattttggaagatggtaggttttttggttgcattgtatgatagaagcctttgctgaggacctgggcatattacattattcaaatgtaatcagtcaccaatttatatccatttgcaatggtagcaattacctaatcttgcttgtaagaatttcagagtgtctggttatgaatgtaacatttacatgcaataattatcatagtgttttaggtaatgcatgcctcaccatgaaagaaatttatttaaatgttttagcaataggaatctcatttttctttcctctggtctaatgaaccatagggtttgcttcatagcatttttaatgtgagactattctattcattcaagaagaaagacagtttgggcagataataatagtattacagaacgagatggttttcacagtattcagccatattgatctgtccatttctattgccttttctgatacccacaatggatattttccttcctgggaccagtgatactataaaaataggctttctatctgtcttttacaaaatgggtagaaacatagagggattgaattatcacaaaaaatagtgcaaatgtggaaggctgtgagtcaccatgttagaacataaggatgcaagtggtccctaatccttcctgagtgattgccttgctgatttcagctgtccagaacattgaaggactagagcaggggaatcagctctcatatgagggaagcagcatacctctggctttctttggtaagactttctttctgaatgatcagccaccttgggcattcagaagccacatgaggaggctgaagcacacagcttctgcaagtgtatcatcaccatgaaattgtagagctgtgaactctgtggataaatctattttctttccctggtgcctcatttcctaactacactggcacttccctggcagattgtcttattcagggtatcaattgctatgaagagtcaccatgttttgtttgtttgtttgtttttctctgtggcttttggaggctgtcctggaaccaactcttgtagaccaggctggtctcaaactcacagagatctgcctgcctctgcctccctagtgctgggattaaagacgtgtgccaccaccacttggtaactgtggcaactcttgttttaaaattaaatgtattcatttattttacatcctaaaaacagttgcccctccttcctctcatcccattcccttttctcacctcctctctgttccctccaccagccaatccactcctgctctgtttctcttcagaaaggaaaggccttccatggtgtcaacaaagcatgacatacatatcaagttgaagtaggattaattcctctttctgtattaatgttggaacaggcaacccagtatggagaataggttcccaaaggctacctcaagccttatggacaggccctgactcattgctaggaggcccacaaatagaccaagctacacaactgtcacacacatgcagagggcctaggttggtcccatgcaggcttcctacctctctgttcagagtgtgagctgctacgagcccagggttggtttgtgatgaccatgacctccccttgcatctatgatccttcctttgtctcttcaacagaattccctgagcttggcttagtacttgtctgtgaatctctgcatctgcttctatcatttactggatggaggctctttcatgacaattagggtagtcaccagtctgattacaggagatgaacagttcaggctacctatccactattattgagagtcttagctggtgtcatccttgtagatttgtgagagttttcctggcatcaggtttctatctgaccccaaaaggccactcacatcaagatatctcttttagtattctcctcctcaagcctgctcccaaccctatccctcaggatcccatccaacctactcccagtttacccaggagatctccagtatttcccctttctagggaaatccatatgtcctcatcccccttggggctttccctgttacctagcctctttgaggctgtggactgtagcatggttattctttactttaaaactagtatctaatcatgagtgcttacataccatgtttgtcattatggatctaggttctctcattcaagataattttttatagttccatttgccttcacatttcttgatgtcattgttttaacagctgagtaatactccattgtgtaaatataccacattttctttattcattcttcagttgagggacatggagattgttcccaggttttggctattatgaataatgctatgatgaacatagttcacaaagcatccttgtggtatgattgagcattctttgggtatatgcccgagattggtatatttgggtcttgaggtagattgattctcaattttctgaggaaccaccatatcaatttccagaatgtctgtacaagtttgcactcccaccagcaatgctggagtgttccccttgctccacattctctccagcgtgagctattacttgtgggtttgatattaaccattctgacaggtgtaagatgcaatctcagaggcattttgatttgtatttccctgttggctaaggatatttaacaattctttgtgtctttggccatttgagattcttctggtgagaattctgtattgatacctgtaccccattttttaaaattgagttattcaagcttttttgatgtttggtttcttgagttctatatatatttggagatcagccatctgtcagatgtggggttggtgaagagtttttccattctgtatgctgtcattttgtcttattggcagtgtcctttgactttagaagcttctcagtttcaggaggtcccatttattaattgttggtctcagtgtctgtgctactggtggtaatagtcaggaagtggtcttctgtgccaatgctttcaagtctacttcccactttttcttctatgggattcaatataactggatttttgttgaggtctttgattcattagactgcttctgcagttatgtgagtaagtatgctttcataatgtaggacttaggaaaatcagaggcttcctgttgggaggggttggaatctattactgttatctgcttcctacaatttagctcttacttgcctgtgcatgtatgtttatacagtgtgagtgtgtatgtgtgtatgtgtgtgtgcgcgcacacacttgtttgtttgtatatatgtgtgtttgtgtggtcaaaattcaaactccagtgtcattcctcaagagctattcctcttgttttataagattgtcattcactgggtcctaagaatctccaagtaggctagggaaagtagctagcaaggctcagatatctgcttctgctgcccagcactgggattacacatttatgctgctactgttgtgtattgagataacataggttctcaggcttgtgtggcaagtactctatcaatggagccatttcccctggcccactattggccaagtggttaattctttaagaccaagtcctttcccccctttctctaaatacacctaggtggaccctggccttacacacataaagtagaggcctgtgatacttctgtttaagaatacttgcaggtacctttacagaaacaaatccactaaagagaagcacttgtgaaataaaggcagggacatggactttggacccctagattctctgtggagaagggaaatgtggagagcttgtcagagctctgtggggggacagttatcctttctgcagtgtagcagaaaggctattttctgtggtacttgacaggtgcatgagttctaatccttgtatctattttgaaactttgcttgcccagggagcaaacatctgtctgggaacacagataggcagtgattcaaatgctattccttgctatcaggagcgtggtagattataactggtgattagttggtttcaaatttggaataaagtcattgtaatcagttaaggagggaggtctttcagatctttccctctgctcattaatatcatgttatgatatttccctttgcaaagataaaccttccctttcaaaagtactcatctgctctggttctcagcagaacactaactcatattttctttgcttttactctgagaattttaaactgaactctacttgcagaattttttatctgctgactacagattaggtgcatctgccaagcatgctgtgttatgttaattttaattctagttcatcagaattactaagcatgtagtaactttgaactgaatattttattgagtttcaatactggtaaggttttaaatttgggataaacttttaaatattagccaacaaattttaaggactttgcattataacctcccagtttgattacatagaaaaatcaatgattcaaattttaatgtccataaaagtaaaaataaattttaaataggactttaccattttacatacgatgttttatatctgcagaaataaataatacttctgtcttcatttactttcatgttgtggtgatagaaaatacattgaagtaacaccttaagaggggaacggcatattgttcctcacaatttcaggtgtcagacattgtggagatatcaacgtagtaagaacttgaagcagcagttgtatcacatccacagtcaagagcagagagaagaaactcattgcacgcttgcttgccctcacctcctttctccacacttagttcagaatgtcttgcccagggaatggtgccacctacagtagatgacgtctttctacctcaattagataattcccactgacatacctaaaagccaacctcactcgtagaaactccttccaagatgtttctggatcagttggtttttagtttcttgagttcgttgtatattttggaaatcagctctctgtcagatgtggggttggtaaataccttttcccattctgtgggctgtcattttgtcttgttggctgtctcctttgccttacagaagcttctcagtttcaggaggtcccatttattaattatcaaactcattgtctgtgctactagtgttatgttcaggaagtctcttgtaacaatttgttcgagggtaccatctaccttattttctaagaggttcagtgtggctggatttatggtgaagtatttgatccatttggacttaagttttgtgcacggcgacggatatggatctatctgcagtcttctacatatcagcatccagttatgccagcaccattttttgaagatgctttcttttttacattgtgtaattttagcttctttgtcaaaaatcaggtgttcataggtgtatgggttaacatcagtattttcaattcgattctattggtctacctgtctatttttgtgccaataccaagctgttttcaggattgtagctctacaataaagcttgaagtcagggatggtgatatctgcggaagtttctttattgtacagggttgttttagttatcctgggtctttttttcatataaagttaagaattattcttttaaggtcagtgaagaattgtgtgggattttgatgggaattgcattgaatctgtagattgctgttggcaagattgccatttttactatgttgatcctacctgtgcaagaacatgggagatccttccattttctagtatcttctttagtttctttctttaaagactcaaaattctcatgatacaattctttcaataaaagggacacagaactatagacaattctcaataaggaatctaaaatggctgaaagacacataagaaattgctcaacatccttagccatcagggaaatgcaaatcaaaacatctttgagataacatcttattcctgtcagaatggctaaaattaaaaaaaaaagcaccaatggcagtttatgctggagaggatgtggagaaaggggatcactcttccactaatggtgggagtgccaactcgtacagccactttggaaatcattatggcagttcctcaggaaaatgataatcaatctaccacaagatccagcaattccattattaggcatatacccaaaagatgcacatccatacaacaagaacatccatttaaacatgttcatagcagaattatttgtaatagccagaaactggaagcaacctagctgcccctcaactgaagaatggatggagaaaatgtggtaagtttacacaatggagtactactcagcagaaaaaaaaagacaataaaaaacaaacaaacaaacaaaaaaagacaatggaatcttgaaattcacaagcaaatggatggaactagaagaaaccatccctgatggctaaggatgttaaacatgtccttaattgtcatttggccatttgagattattctggtgagaattctctgcaccccatttttaattgggctattttgtattttttgtgtctagtttcttaataaattttggagatcagcggtctgtcagatgtaagattggtgaagaccttttcccattctgtaggctgtcattttgtcttactgacagtgtcctttgccttacagaagcttttcagtttcaggaggtcccattgattgatgattgctttctgtgtctgtgctctcagtgttatatttgggaagtggtctcctgtgccaatgtgttccaggctacttcccactttcctttctctcaggttcaatgtatctggatttatgttgaggtccttgatccacttggatttgagttttgtgcatggtgatagatatgaatctatttgcaatcttctatgtgttatcaaccagttatgccagcaccatttgttaaagatgttttcctttttccactgtagcattttggcacctttgtcaagaatcagatgttcacaggtgtgtggattgattgatatcagggtcattgatttgattccattgatctacctgtctgttttagccaataccaagctctttttattattataactctatagtatattttgaagtcagggatggtgatgcctccagaagttcctttattgtacaggattgttgtagctattttgggttttttgtttttccatatgaacttgagtattgttctttcgtggtctgtgaagagttttgttggaattttttgatcgagatttcattgaatttgtagattgcttttggtaggattgccatttttattatgttgtttctacctatcaaagagcatgggtgatttttccattttctgatatcatcttcaatttctttctttagggacttaaaagtcttgtcatacaggtatttaactagttcgggtagtgttaccccaagatattttataattgtggctattgtaaagggtggtgtttctctgatttctttctcagtgcctttatcttttgtatataggaaggctacttttttttttgagttaatcttgtatcctgccacattagagagaacttttaaggacaaatattttttgggggggggtttcgagacagggtttctctgtgtagctttggagcctatcctggcacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtttgtgtgtgtgtgtgtgtgtatgtgtgtgtttgtgtgtgtgtgtgtgtgtgtgtgtgtgccagtgttcaacattgattgtcttcctcaatcaatccttacttaattttttgagacaggatttctcattgaacctggggcctactggttcagctaggctgttgtgccagaaagcctcagggacccacttgtctttgcttcccagcattgggattcaggcatatgataccacacctggcttttatatggatgcctgaactcagatgctcatgcttttgtggcaaacactttaagcaatgactcatctctagcacctcaccatgagagacactgattattgtgtagagttgttttggcccatacctgtatggacactactggcttcaagaaaccaaagatgctgctgagcactcacaggttatgctggacaattcctgtacttcaccctgtcccacagtatccatagtgccaaaggaaagaagctctgttgctgaaatctgagataaagaaactgtccacaatgacataggcagatttgtaagagacatttcattttatgtcagtgtcttctaattcctttactttgtgctgttggttgtttacttaggaatccctaataaacaataataataccttaaaatgtaaatgaaaaagaataacattgcatagtacatgtgttactctacattgcagtaaaaaatgtctcaatcatctagctaacagtttaacgaagattgaaatgtaatacactgtttgcaaagacctaggcagctgggagactgagagataaatagatttgaatcaaaaagtaactctgtaaaatattttttaaatgctctgtaaatgcagatgaattgagaaatgattatgcccacagttgacacagggaatgaagcttctgagaattagtaacataatcaggtacataaaaaataaatagctttctaggtgggaaagaggtaaataatatcaaagtgtcattttgcaaactattaagaggaccatactgtagtatgactgaatattccatgaatgagcatgcttcatatcctaagttcattgtcagtttctgggacaaaaaactctgacaaagaggcttaggggataaagggcttattttatttcagaattccagactctagtccattattgcatatataccaaaatggaaagaacttaaagcagcttgtcatgtcacaactatgtataatatgaatgacaaatgagttaatgtgtgcatacatattgctcaactcttataccacctaggctcccctgcctaggaaatggtggcacccacagcagcctgtgttctgttccatcagaaatcacaaaaatcccaacagacatacccacctagcaatctggtcagaaaaaccctgttgagattctcttgccaggtgattctatgttgtgtcaagctgacagttaaaaccaactatcacaatcctaggaagtggaaatggaaatttgcagcacagacatacagtaaatgtatggagtaaaccaagatgtccatatgtgggaaaatgattgaagaaaatatgacatttgtgggtatacaaataatagattattattcagccattaaaataattgttgagtgtagtatatagaattggaggaaaaaagcatgggggaggagaataatgagtaggtattacatacataatgaaaatttcaaagcatatatctatttaataataaaaaagaaatattgcaatttgaagcaacataaatggaactggaagacatgaaattaagagaattaagccaggcacagaaagagagatgttatgaattcttgttcccccaaggaagataaactaagtgctttcagagcacagattaggagagtgatcattggtgagtttgaagtgtgggttagtggtgttttctagaacagtagggtatgcatagcttactaagaatttgaagagttggaacattaaatattcaaagatgtagaaatgctaatttctctgatttgatcattacggatagaatgtatgtgtcaaattatcacactgaatcatacaaatatgcacaagtttcatgtgttgttaaataattagcacagattgtagtgatttgcttgttggaattatttgaggtcaaaacacaagtcaagagagaatgctattctgcaataaagatttaaacatctttactacaacatttgaaaattcaccgcaggaaatcatttctctttggcttaaaaatggacccttttcttcccatgatcacaagagcagtgtgtctagacacatcatgacccaaaagtatcttcagaggacagtgcatatacaactatttctttttatgaaaataactgactctcacagggataatggtctctggtggcagagaagagtggcatcaccagggacataaaaaataagaaatctgtgtggaaagacagatacttggctctaccacattttgttctttcttcacataagctctaagtggtaggctttggatagattcattactcaacttttgatgattatggaatcttgaatcttaatgataattattcatgttttttgattaaggttttccaaagttgccttgataggttaaatgtcttttacagttttacttaccttgagtgatccctcagccagctgatcctgcctgtacagaggtagtgagtgaaagacattgtgatacagataaactcttgacatgtgtccctcacaggattgataactcagacattagtaagcaagaatctgagttggcattcgatcatttaaggtattttatgaatcagacaaaagacaccctcctctcactgctctaccatgtaggaaagccctgttttttccttgctatctcgaggaactgttataggactagttaatggccatggctgccagctaagggggtggttgcaattcatacccatttacctccctttactttatgtatttgtgttgagaaaagttggaatgagaagcaggattagtaatgagcccttaatgtggttacctctagtgagagaaagaatagggctggagttggacccattatcactctgtcaacagttcttattaagatggtggcatttagacacttccctggctctcagtctgtatgtcgactgcatggacatgctccattatctctgaaggactttatttgccctcagaggtatgcctctgactctacttgtcaccatacccatgtactgtacctttctgtattacaaatctagccacatcacctcagtctgttctcctttttcagccatcagcatcatttagcaatcacatgttttgtaagatcatggatggcctttccttttaggtatctataagcattcagttctatccctatccttcatttacccacaccctggagtcataaaattaggagctctgccttgtgatggtgatggtgatggtgactttccatcctacctgcatgagctggggagaaaccattttgctttgttccaaggaacttagctttagagaacagctactctttttgcaagcaagtattcttgttcaagctttgtgggagttcactatgtcagctaacactcagtcagcatttgaaagcacactgtgtgctaagaccctgtttagatctgtactgcaagcctggttttgtatattgtgctgtgtctcagaaaaggtaatattataaagaaattaaagaaatcatatcactaggtcttctgtgattgaatcagagttaagtgttaagtgagaattctctgtgtgaaatgttgtaataatagaatttagggagcccaatgtgagggttccagggatgtttgctaaacattattagatcgtgtggttgcacagcaggtttgattatgccttcccatctcgacagcagcttttcacaatggttgtgcctatttcatcactttactcttgtaaagtgtttgcgttgtttttctgaaagttgtaagacttatctcccgtgttaggctgaatttcttgattatggcatcttgattagtcatacccgtaggtaaggaagcacttctgtttggtgattttctccctcatcaggtttatattatgattcgttttatttgattttgattagaaccttatttctgttttgactttaatgtccagtatttttgtcttaccgtagctgttacaaatattgtgtgtgtgttcatgtatgttaatgtgcattctcactctccccctccttccctccctccctccctcttcatccccaacagccccgtgtgtgtgtgtgtgtgtgtgtgtgtgtgtgtgtgtgtgtgtgtgtgtgtgtgtgcgcgcgcgtgcgcgtgcacaagcatgaattcagagggtactgtttaaaacttccttgtctatttccaacttatgagttcctgggatggaagaacttgggtcatcatgcttggtaacaagtgcctttatctgctgagctatctcactgtctgatcctattctttagttttaataaggtgatttcttagtttctcatattttgtgcttgtttcatgtgtgttacttattataaagtttgttctcttcatgcatatatattcaagttgataaagcatatagaatgtctaaaaacaaagttaaaaattaatttgtatataatgttatgatgtccatgtaactcaaattttgtcactgcaatataattcttattataaggctatactgggataatttcccaaagaataagaaatcattttcaggaaatcacattgttttaataaacagttgtcatccacctgtcattttggtagcaacttttataaattagtatttatgggctccatcttaacaaaaatatttcaactaataaagacagttgtttgcaatcatttatggattttctttagagattcaggacagtgttagcagttctttttatcttgctgaccggtggagatgatatgctatttaactctgttcagaatggtcttacctatgcaaagtggataaagagcctggagagtgtccttgacgttcttgacctattatcgttttaagtgtttcatgtgaggacttccatttcaaccaagctgcttgagtgggataaaattgaaaagtaaaatgaattctcttcccatcattggttgttatatattagaactagagcctttaattagcatataagtgaggaaagtgtcatctccttcttaaatagggagcattctcatctggagaaggtggcagctcttacattaaaacctgacttagcaaggtttctaacagttattcaaaggccattctatctgaggatgaagaatttaaccaaaaaggtagtgttatctgatttagcattataatggaaagaattggggaaagaaaatagctatgtaaaaatatgtatgaatataaaaaaaatggcaggaactaaggtaaaaaaggaaggtatgtcacctagtttttcattgctgtgacaaatgtacctgacaagactcaattaaaggaagggatggtttgttcaaacttatagcttgaaggaatacagtccagtgtttttgggaaggcatggcagcaggtgtagaaagctgctgattgcattgtacctgccatcaagaagcaggaagaacaaacaagaagtagagttgagctctaaattctcaagcttcccagccatacatttttttcctgaatggcttcagctcttaaaggttctaaatagcacctttcctaaatatcatcatcagctggatgtccagacatgagagtctgtgcaacatttcactctcaagacataataggaaagaactatatttttctaaagctaattattatttacaagaaaatcagactaagatgcaagtcttgaagagctattatcaggattagaattcatggaatgaggtgtttggaattcaaaaaggaaaaagagatgggggaaggaggaggaaggatggagggggagagagcagcctgacttcacgacctttacctttgttaagagttggctgctgaataaggtcattgcatttcttttgcaagcaggggaaatctgttagagtatttgagcatctctaataatgtattattctatagtttagtaactaactatatggattgctaacacaggtttacataagctgagaagctgattgcagtaacctagcctgatgtggtgatatattgtttatgatctaataaagtcaatgaagattagaactcaatgctagccacattagacagccacagaatttgggtagtgttgccacacacctttaatgccaggactcagaaagcagagacagatagatatctaggagtacaaggccacctagggctacatgagagtgaatcggtctaacagagaagcagagctcacatctttaaccccagcactagcgagtcatctaagaaggagaccagggtctcatgcagcattcactattcagtctcagagcaattagtctcctccaggcatgttgaggtcaggatctcactgactttggtagaggtcagagctctcttgtgcttggccaccttgcttttctgatcttcaactttaaccccaatatcaatactattattggtactacagcctggtgttaaaaagaaactcaaaccagtatcagggtgggttggaatgtagagttggaataaaagaaagtgagaacatgaatcaaaacaccatcctatgcgttctcatgctcctcgtgccatgtttccaaccacgatggactgtccctgaactgtaagccagagtaagccatcacttccttaagtagcattttgtcacatcattgagaaagtagctaatatagcttctctttgtctctaggagatgacatgattctggcttctcacaaagacatcaccagtgaatatgtatgagtgagtggtgtcttgagtgacaggagagcccattttatgtagtcaaagctcttaaactctctttcactgtccttttccctttcaaaaagaaattccacagaaatgttaaggttgcttttaaatttatgtcatctacttcacagggagtattccaatatagcagctattaaaaattctaatagctgtgtgtttctgtatgagctgctatttggtgtatgtcttgcacatattcacttactcacacatgtatcccccactttatttttcccaggcctggggatataatacaaagccttgcctgcaataggtaaattttctcagtcccaaccttcatcctctgctttctgagaaatgtctcagtgttccataccaatacttcaattatttttatgtagcttttagtctggactattgtttacctactatgggctgagtgcacctggaggccactgtggtagtgagatgcctttctgtactcatggtaccggtgttatacctttcagaaggaaagagatccagggttgctacaatgttctcacttactacttttgatttaaaggccatgtgctgtttaattttctccaaacttgacacaagtcaggggcatttgagaagaaggaccgtcgactgaggaaaaaatgcctccatcagattgttttagagaaaagtgttgggcattttcttgctttaatcattgatttaggagtacccagctcaaatatggatgatgtcaccaggaagaagtggtcctaggttgtataagaaagtaagctgaacaagctatgagaaacaagccagttagcagcatctattgatgtctgctttaattcttgccttgctttagtttctatccaccttccctccctcagtgatgaactgttaacttgaagtgtaacatgaactaaaccttttcctccccaagatgctttttgtcttggtgtttttcagcaacagaaatctggctatgaaaggcttcatgtagtttttagaggtattaaacaaaagcacatgccctggctacttctgtgtggctgcatggtgagatgccaagtctagctgagtttcacctttgtttgaaataagaacatattggcagtctctcaatggttatgatttgattgattagttccttgtctagtggcaatgaaactggactgaagacagagtggtaagatgactgttcttgacagtcaatacgtttagttaaacggtattgccttgtgtctctttctgtagttgctctgtttggattgcagatatgctcaaggaggtcagagaagtagatttccgagatgcatcacatagatatctcttggactttgattggcctaatttctccctcctccccaatgccaaaggaagaataaattgatgttaagtaaataaatactgtggaagatgctacaatgagctccataacttattctaatggtagctcactgttcagtctctcctctgcattttctttatctctttaccaataagtggtaaaaatgtgatatgtacaaataatgcagaaaggaaaacaagggtctgactggtgagcctccattcatcagaacatttgaatttcatggcagaggttgggaaacattttcggtaattagcccaataaatttctagtctaatttcacatctctgatgccgtgaaataccaaccacagacagtgtggatgtggctatgtttccattgcaggatgtttggattctgtgcaatattcctgtgttgtgagctattaatttttacttttttaaagcaatcattattgttcttggtttcgatactataaaatgcaagtgaggattttgtaaaacttaatagccatagtttatcaagcaggggatagaaagaacaaaacctttgggcatgaaggtttgacaatacttacaatatataccatgtataaattcttactctgtttgccattctgcaaagtactttatacatccatcatttaatctgcaaaggaattctgcatgtggcattcttaattcaatcttttgagaactaatagtaactcaggtaactttggaattattttccaattacaatgtgattctggtaaaccaaaaaccttgtcttcagcagcttttcagatgaaattaataagtgaatctactaacgtatgaccttgcttcctgattgtaatttctttttttaatgacatgaaagagactagagtgatcatgttcaacatatttttatattacttacaatgaatctacaataaaatttgatgctatgcttgatttaactatccatgaaattgcctaataaattctaaaaaaattagctctcctgggtcaggtatctgacaaggattagggggccctcattctccacatttccccacattagaattcttgttctattaacccatacttttatgaatgaagaaagcttatgtaactttggctgtgactctggataaagcaatagacgtgacttatttctttttctttatttttgtattgtatgtgtgatgtgaatgcatgtatatgaatgggcagcggatgtggatgtgtgttgggggcatgagtgtttatgtgtccatgtgcatttggagggctcagttgttattgggtggctctcctaattgctctccatctcattgagtcaatgtattgagtcagtatctctcacttgaatctagacctcatcatttgggatattctagttagacagcttgttgcagagattcgctgtttcacatattcagagattgttggtgaccgccacgcccaatttaggagttatactggtgcttgggatccaaattctggtcctcacactttacctgacaacacatttcctcaacctcaggcatgaattatttttaaaaaaattagaccccaatagtatagaaaacatgtatctttcccattaaataatactgttgaagggctggaaaatgactcaataagtaagaacacttgtagaagaattaagttcattgatagcaccaatatccaggcacttaaaattgcttcattgggaactaatgcacttttaatgcctctgtgggtacccctgtgtgtgtagtacacacacacactcactcacacacacacacacacacacacacacacacacacacacacacacatgcaaaatcataatatgagtaaaagtaaatattataaaacttactctgtgttctttaatggattattaaagtatgataaggcaaaaatacatgtatgagaatgcccccatctttattttaagtgttttttttgggggggcatggcaatgctggtaatgggtagcaagggctagggcattttcccttcactagtttaacactacatgaacaaagtgaagaaaattcaaatagtacatatgtgttttataataagaacattatgtgctgattattgtgtgagctaagaggcaaaattgttaatttattctcttattggcccagaaatggaaatttttcaccatattatccttctgtttggagtcacaatctccagggttaaactcagcttatgatgttcacagtctgtcatttctccaatcaatagctagaaaattgtgctctaatggtaagcttaagatcctgtgtcatgtctactttgttgtatttataaattttatgcaaagaacaataacactagatagctatatatgaacacatacacatttacttcctaaatattgtcttgtaaaatcagttctttacagtaggtactacatatttttgaaggctactgttttataaaaacatgtcttatttcttctaagtatttttatttatttgaaatttcaagcatttataaagttatttattcatatccattcactactacctcccaacaactccttttaatactaccaaatcatttcctttttaacattataacctctttctttttcattaataacccgctggatctaatcaatgctgcccatatgtacaaaggtgtgttttttagagtagtaaattcacttactgaatgtcaaacttagtgctcaaaccagagtacatctgcaggaagccacactactattatcattttaccctcttctacctaatatctttgatgtgaatggataccaacttagttttggaggtatgatgaggtataatgaaaaaacttcttatgttttactataatatattagtacagtgaggtagacccgagttttagtatgccagcaccaataaagtgggaaagaggatggttataagttgtttagaatatttttatctaagttttcaaatgaattttctgaagttgcttttatattaaatttaagtataaatctcatacttaaattttaagtctaaagattttaagtatgaagatttaaatatgaagctttaggtagagtaaatcacatgaatatggaatagaagcacacagtgccatttattctttcagtcatttactagttttagggtgcctgctatggaccatgccttgagtgaggccattagatacatagtgatgagcaacgagatttgagctcatcaaaagacacagtgggttaaatgctcaataagggttggagatgtggctcagtgggtgaagtgcttgtcacactgacacctgaagacctgaacttaattccacacaagccacttaaaactggatgcagaagtacacatctgcattctaagcatgtctatagagagatggaaaatggacacaggaaagcactcattcatatatgaacgtgtacaccacagggtaagacagagagaggggcggaggtgatttcttaaaatgcttactaaagcacttatgtctaaagggactaataaagagtgaatatacaagacagtctgaattttattggctgatatagaagccatgcttatacttgtgttgttggagtggaagaagtaaaatgggagtgattatgatcacaaagtgttcatgggattaattggccaagtgattagctgatacgttgatggagcatatggacaggttagcaaatatagcagagtaaggagatagcctcaattaccacaaggagctgttagtctgcagtgctgctcagtggtgctcatagagtctgtagttttctcagacaattgaactcattgtcttctttgttgacctccctttaaagaatccttctattgcatcctatccagaggactgtattccctgtcacactgactaagattataaacctcatcggctgaggtttataatggtactgtttccctccctcattttgtaactttaatggtgtcagttgaaaggcaatgccttctctgtttgcctggacatattcactgcctcacatactgactctcaatacatattcctctgatttgtaagtaattgtaagccacctacttcagtcatgggtcttgtgcaagggcaatatacattcttattgacttgagtcttctctctggaacatcattgttattttaagaaaattatgtattaattcacttgacacttgttatccaaattggatccactgtgtcctttaatctaaaaaagatgcaaaatccttcctataaaatgcctaaagctatttgtgtaatctactgacatagttacaatcaccttaaattatttctagcacccagtgtaacataaatttgtatataaacagtttctatgctatattgttgaggaaataatagcaacaaaataaagatgttcacatgttttgtgtagaagaattaattttttttagccttcagttgaactcatgtatgtgaaactcatagataatgaggtccgacgatttcaaagaaagtttggattgttagaaatgatagagaaggaaagccaagaataaatatgcaaatgggtttgtagtctttgtaaaggcctttcttctacttttttattaattaaaaaatatatatgtatgtgcatgtatgtgggagggaatatgcccatgaatgcagtacccatagaggccagatgagggccttggatcctctggagctggagttggagttggttgtaagtggtaccgtgtgagtactgtggactgaacttggaccctctcaaggtcaatatgtgttcagtatctatctttccaggctgttttgttaatttttaattttcctggcatgtacataaacattatctgctagagaagtaagcagtcaaatgactatccatctttctacctctgactttgcattgtcctttattttttacaagctctgctgaacctggagagatagaagttttaaaatattgaaaagattcaacgtagggctctcttggaacaacttcacaggctttccgttgtcttgtgaagattttcacttgctttgtttatcgaatgtcacttgtgaatgtctgttgcattcatcccattgtcatcagtattagtactgagaatgaacaatgatgagacattgtcaggatgctaacatcttcctttcttcctgttttgacattgtgattgaaatatacatgagcactctatcaaatgagctcccaacagtccacttgtcagcaagtggctagctctttatgtgctgtatatgggtatggctctggctttctggagaagagtaggcttgcttgtagctggcgtacaagcaagggtgaattcatacatggcttccatagttaaggagcagaaagcattcttgacacaggctttctgcttactgttctccaactgagcctgatggttacacattactgtctctggccacagtggatgcctttatgagtgttctagcagtactagctcctactacactgacttgactttgacgtctaagcatcacctcatttctgctgctgctcatagtaccgaagtttagactaatactcagggacattgtgcctgaatatgtgcactgtacctgtgtgtgctttcttcttactaggtcagaagatctgaatcttgtctccacatcctttaagtattgcttctgatgggaagctttccctgtataatttggatatcagcatggctgcaacatggattgcctcaacctctatcccaagtctggtgcatgggttattactgacttcagtcttgtaaaacccaaccaggaatatcatggtacagaaaggcctatggcagcaccagcatcactctctatctggctttctgagtctattatccattttctcctcacttacctcagagttttttattttttgatttgcatgcttataccgtgataggcagtacatagtagtgtacagaccatggaaaggtaaccctggagtttatattatggttagatgctctgtacatccctggagatgtctgtttattctcttattttaggttgttgtttgttctagagccatccctgggatagttagacagagcaggctcagcactcctttttaatctaacaactcactatttggaattctttcatcttctcacattaatgacttttgtaatctttccattaaaacatttattactaatagatttaacatggacctcccacagtcctccttccccccttgatacctgctatgtgtgtccatgaagaagtagtcaaagccatttaatgaatggatggtgttgctaatgaagtacatgtgaacccagttacctctcacttctgctctagaccagaggacccattggtttgtatctcctcaaagtgggactgcaaggtcaggctaactttgggaaatatgctgccataaagaactatactctaagtcaaactggcactgtcttcatcaaatcatctctgtgatttgcaaaagttcattgtaattgggcatgttgactgttgatgtttctccactgaaggagaggcaaggagggtctttggacctcaccttatatctagtgtgggggaccgaatatttctgttatggaatattttggggcccagtctctagctcctgtaaacaggggcaccggaaagctcctggtcaccatagtattgttaattgccagtagggctactactgtttaccatggcctcagggtaatatgcctcctaatttgcatctctgtagcttaagccttgagtaggcccatgcctgggccgaggactctgcctacatgaccaagagttgtttaggtaatagaatcacttgatgttagctatatgcattataatagatgcttcctgatgttcctgcccttggaggactgtttaaatggacttctcaataaactgtggctgctcagcatcagctgggagccctcctgagttgatatggtgtttcctgtctcatcattagcatcgctgggtaattaaactttcctagtccacacacctccactcagaatcggacctgggactatacggctggctcctttcacagtcctgaagacatcggtcccgaacaatctagccactctctttaaccagttgtatcaagttttaccccaatttcatccaaattcatgggtaagatttgactatataggcaagaaatatcttagggaagggccctatctatgtggccatggatgtgtcatcatatgtgcagattcagaacttctagtgttacatctttaaggccactcacattcctgcctatatcccctcacccattggtctgtaagtatgcctttcgaattcattagctcccaagtgtaaattttggtgaaatcatacctcactttgtttttagggagacaggtgaatggacattgtttgggtttctaccagagaaagaatttagtgacacatgtatttgacatatatatatatatatatatatatatatatatacacacacacacacatatatacacaaacttagccaacagtttgtagatatccatgaataacttttttgtagttgttaacatttaaataacagcttttcatttttggctctgggtaactttaactcttttgattagaaaacactgaaatgaacttctggtgaatttcctatcagatatctatatctatctatctatctatctatctatctatctatctatctatatgtgtgtgtgtgtgtgtgtgtgtgtgtgtgtgtgtgtgtagctttagttaagcatttatatttctttctatatagcagtaatagagatagattgattgactaatatataaatcactgattagagaaagaagaaaatggaagatctcagaacacatattatgatttggtttgtaattgtgagttaaaaaaaatcatggctataaaaaaacaagtcagttttaaattgtctaattaggcaatcagttgtgttgcttatctgcatccacaaagagctcataggaaaccggaagtgactacatgttgcctaattagtccaattaaacacctgcctaagatttcctagcttacaaaactccccactcttaaaatgactagtgcactgctaaaaatataacttccaaatctaagtgttttatttgaaaaattggggaactattctcagaatactgtatgaaaaaaatgtaaagaaaatacatgtgaacttttttcttcagctttttaaaagaagtaacactttgtttccatgtttctcaaatccagccgactgagttggttgctttcagagtgttagtcaaagagaccacatatcatatccccatctgagtcctccaagtctttcttgatttcatccttgcctgggagtagagcagtggcagaaacagcagtggtggtagcaggctcagcagcagcacctaggaacacagatagctcagacaagaagccttgaccttttcagcaggtgtaatcagcctccaaagacaaaacaaggaaccatttatgtccactgatgatagaatgtgatacgggagcaacagtaagcaaacataagctgacaacatcattagcattctccagaaagaagagtttgcagattcttgagggttctttttattttagagctgggggtaaaaagggaagcaccaagagtttgattggtttcagtaacacacagtgaatgcatggctagttagagttcacatccaaatattcccagccatcaccttatatgtcaggatcctgtcccacatggttactgattatacatccaatatagtagtagatgtcactttagttaccgagctaatgtgtctcagataaactgctgcatttaacattcaaaatctccctgggaattcaatgccattattatttcaaaatagaaaagtgaatatgagattcagtctttttccacccagataaggagtggaagtctccagaacctggggaaattgctgtggacctgaggtagattctccaaaactcacctaaaaactcagatgtgctggctagatttcattgcactcaaagatgctatacaggttactggtagacagaagctatgattgatttaccctgcagtgggccatgcatgctacagcactggtctgtcaggaagttgtaatagttgcaagactgtttggaggctaaccaattgttttctgattagatttgaggcctattccaaaggagggaaatcatgtctggtgtgaccaacctggctcaaagatcatcactgggcaggtcataggccttggtggggacacctactactgttgttttgtgagacagccatggtgttaaactgcctgttaaatatttatgttagtatctgtcgatcagcactgttcttaaccttgctcagagaagcttctctttgcagtggacagcagtggatgcagaaacaaagacctggtcaattttctgagagcaagtggctattgagtgtttgccacaaaacgagacatctatagcaacccacctaaaaaattcagggaacatcgcagaagagttgggaagaattaagagataggggatgcgaaagagggctatgacatgttgtctcctagacaagacatggctgttgaactgatgttgaatttatggctacttaaacaagagctgtacaagatgtagactaactatagctgttttgtaatcttttatatttctgtgtacagctatcagattgtccatgttcttataggaaaccctaactaagacatttaaaaataagtaagacatgaaagttggaagggtacttactagccaggaggaggggccgaggaagtgggagtgaggatctagacatggatgtgatcaagatacaatgtatatgggcataaaatcattaaatatatgtaaggtattacagatatataatgttctttggctattccattcatgtacaaaatgcattctgattactgtcccccttttagtctcctcctcctcctgttaagcccctcttccctttcaatcattcatttcttgtttgaaacccactgtatacacacacacacacacacacacacacacacacacacacacacacacacggaaatctccatagctgttcctctcttccctagatcatgtttctcccttttacagtcttttcacccaacaatgcttcattcctgatcacccaagtcccatcctacgatttctgtgcactagtgttttaaagagaaattttgtctgtctttagatagaaaatgaggtgcctcttttttacaaattgtccaaataaaggtacagaagaagaatcttgacaagtataattacatcctgctcatttacccctccttgcatcaacaaatccccagagccttcagagaagcaaagcttaaggagcacggtgcacaccaaggcagtgcattcaagtgttctgtccgtgaagctgacccacagtaaatgtcaacgtggtcttttctcatgctattggcatttcaccagcagcttgtagtttaatgggagaacaataatgtacacgtacatatcaaatccagaaaatgtcagcagattatgtaattatctctttgaaaggctaggaattcttttaaaatagagtatgtccttcatgctctgaggaaattctacagacacaccagttagctagccataagaacaattgatttttcacttcagaaatttatataatatgtctaatgggacaaacctatactcactattggcttaagggataaacagcacatgtcaaataaatcaagtcttcaagtatttgaaaggtcctgccgcctctattgtgcattttaaaaatctttctttgaatttgttcttgggcaattctattcatgtataaattacaatctgattactgccctctccctttctagtctccttcccacctctgttaagcccctcctccctgcaattccctttcaatcagtgggtttgaagcccactgagtttactcgggattatctacataattgtggatttggaattgtacattggaaccttgtgagtgaatcagagtgtataaagctgaatacaatgacagtttctcccccataatctgtaagtaaccagtggttaaggtccaatgggaacatccctgttctgtggtgggctgttagtaggctcactcttgtgtatatttattgttcatataaccacagatgctgtgagaacgtgacagcattgtctgtgcaagccccctaagatagaatctcacagccttgctcctcttctgcctcaaagtgctttccaccctgtgtacttaatgattcccaagcctcagagcagatagtaaaaaatcctctaacatgcagtttcttttcaactgattcaagaccttctcctagaaataaggacagtacttttaattcctaattcacaaacacactatgtgtaatgggctgggactaattggagagtgttctgtatttggattccattaaaaatggacaaagtgtcactattaataatttgatatttttgattctagaggagaaaaatctagaattaaaatctttcaatcactgaaggattaatattttggaaaacaatttctattcattgttttgtgagatattttctgggtgtgcagatggggaaatatgactttcttgttgctcttagtaggttttgtcaagtcctgtcaagttcaaaagtttgcaagtgctagacactatatatgagaacagtgatattgtctccatgccaagaaatgctaattgattatatgtgtgtgcatatgcacatattaattttatatttaatttcagctattattgttgactttattaatacaaaaatcagtcatttgattctctaaaaggtgacctgaaatttagcttttctatatattctagttatcagaatttcacaacaatatatgtaagatatgtgtcaaatagaaaacctgcaaaagtcaaggcacaggcatatacagagatataaaattataggcaaagatttctactgaagtatgagggagggggggggggggggaaggagggagggagggagggagagagaaggagagagatagagagagagacgactttgtgtctttattgaagcaagaaaatgagtacattatatttaccttatgagttgatgcttttgtttactttcaattgtatatttgagtacagttgcacactgaggccagaaaatggcgtcatttcctatggagctgtagtcatagacaactgtgagccatcctatctgaatgctgggtgacaaactagggtcctccggaagagtagtagcaagtgatcttaaatactgagccatctctccagccggtgtcaaaatgatgtttatagttgtgctgtgctgctgatattttccttaatacacttaagacatttagtaatattaaggaggttaatcctatgcacccttattttggagtagctggtgagtttttataactcaagatgatcatgatattgcacattcgaactacttttgttttgttaatccctagaaggtttctttgttgtggagtttgccacttttgaaagttgcctccaactgataaatgtactaagtatgaactctggctgacaagtgagataacagttgagagggcaagtaagaaagcatgtccttcacctatgttaccaccattgctttggtgatgatttagaccaactccttctccttcgtggtgccatcccctggagccttgatctttctcatcacctttccatgatgtgtttgatgtgttcctgattcttcaagattactttaatctgcattgacattagtggttactgtgccagtcctctactgagtaggtctaagtgacaagaagacttatgaaaagtccctccaatactttctgatgcatgtgttcaaattgtcatggaattttgctgatcattttagttcaaaggaaagggacaactttaaatttctttgcaggagaaaactttgtttttatttataaatgctagttatatgaataatattttcaatttttatcaaattattctcagatactttcgtatacatacacaatgtaatccatttgatctctccacccatcttctcttatctcccatccacccctaccaactcccacacctgtctttcctaattgttcctttcccaaatgcatgacttttcattttgttaaaagacccactacctttaatcaggtaatctgtgtgaacacaggtatagactgtgactccccatttccctgaacctatctacaggaaatagttcaacaatgagaaggacagcaccctgaatccctcttacatccttttcttgctgttaatgggctcacttttggtcaggcacagtgtaataatctgtagtagttgaagattcattattataatagctacatattgttgggaagatggcatttcagtgcccttagtctccctccccactctttggtgtgatcagaaatagcagatgcaggcttggcataatctcttaacagttgcaacacttccctataagtgcatcatgcctgcaatctatggatagttgagggacacttaaaatacaaacaatgatgattaaaaatactagaagatagtaaacaggaagtgcatacagggcctaaagaggccggaagagggcatcggatcaccagaactgggattacagacagttgtaattgtgtaggtgctgggaaccaaacttgggtcccagatagggcagtaagtggtcttaactgctgacccatctctgcaaccacaaagaattttttcagttatttctgtttaagtgtatgtgtgtcagtgtaggccatgtgtctcagggttgctgtgaagagacactatgaccaaggcactcttataaaggaaaacatttactggagtgtctcttacagtttcagatgttcattccattgttgtagaggcaggaatcaaggcagcatacaggcaggcatggtgcaggagaagtaagatctgcaggcagcagaagtagatagtatcactaggcctagattgagcatataagacttcaaagactggcctccacatacttcctccaactaggccacatatactttaacaaggccactaatagtgccactgcctatggaccaagcattcaaacgcatgactcaatgggggggcaatacctattcaaaccaccatatcatgtatatgtggcgggtgcccaaggcagcaaaaaacggctgtgggatactcagagctagagttacaggcaattatgaagggccacatggctctaagatctgaattctagttctgtgcaagaccagcactctctcctcttaatcgtctcccttgatattttgtaattgacatttcttacatttggtaatgagaatttcgacttgagaaaaagcttgcatctgacttgaatgactttagatttgtgatcaggttctccatggtgtagatgtgaaaacatactctgctttttgaaatactgttcagaagctatcaagttatacctaggccattgaaatttcatttaaaaaatggttttcttttactgtatatgaacagtcatgaccatttaaaattgtctcataaggaaaagaggaaatactaccagcaaacctaaaagctttaatctacacaagattgacataaaatattgaaataataatctaaaacatcaaagtaaacagaatgcattgtgtagtgtgtatgtgcacatgtgtgtccatatgtagtccatgctaataagcaaatacttttagcatattcatttgcatatatgggaataaaatgctttagttatttagcagtcattcattcctttttttcctccattttttattgaattagaaacaagattgttttacatgtcaatcccagttccctctctgtccccttctcccctgtcccccactaacaccctacttatcccaactatttctgctccccagggagggtgaggccttccatagggagtcttcagagtctgtcatattctttgggatagtgcttaggccctccctcatgtgtctaggctgagtgggctcctatgctaggtataagtactgatcgactacaagaggccccatagatttctgaggcctcctcactgacacccacattcatggggtctggatcagttccatgctggttcccagcaatcaatctggggaacaagagcttccccttgttcaggtcagctgtttctgtgggtttcaccagcctggtcttgacacctttgctcattcctcctccttcctctgcaactggattccagttcagttcagtgtttagctgtgggtatctgattctacttccattagctgctggatgaaggctctaggatggcatataaggtagtcatcaatctcattatcaggggagggcatttaaggtagcctctccactgttgtttagattgttagttggtgtcatccttgtagatttctggacatttccctagtgcctgattctctttaaacctatactggctccctcttgtatggtagctctttttgctcttcgctattcttccccctacacaaccttcctgctcccttatgtcctcctcacccctcctcttctccccttttcattctcctttactaataacattatatacctcataaaccatgtgtagatatttaataagaatgatataaaattttcaggatgatatttactaactacaaataatatgtgaatacagttaatattagctacagtgcctggttgctcattaaaatctcacacatatagctgattagaaattttcttcttattgcaaaatatccacgtgggcttttctcactcatggtctatattgctccaagggaaaggaactctgcatttttatctttagtagctggcctccaaaattgccggaagggtgatcataatagcccaagtggagagacccgcacattgcactttgtcatgtctgtaaatcaaccaagtcatctccaggtgaggctggcaaacccccacattcagttaggctgtctgggaaacaagttccagtaatgcccccccccccccgccagtctcctcttcagtgccggtattactgttgcctgcctcttttcctcactttcgcatagaatctcggggtgaaactcaggtccttcagctcctgcaaccaccccataaacagcaggcctgtggtgacatttaggggaaggcaggcttggcttaactcagtcctttaattagagctgattggaaaatattttgtatttatcctggtttcatctttctttctagtctcctttgagcagtctggttttgttttgctttaaagttggtaaatgcaaaacagtgaatcatgagtcgagtggagtctttccctaattattttagggactttctagacagcatgggttttctgtcatgggtgctgatgactaaacaacttaagatttttaaaaagacaaatgccttcctactcactttatatttctcgttcaaaacatttgctgctttgctgagaaaaggcattgctgctttgggccacagaaggacactgtgatcagcaccgagtatatgtggcaccgagtcccacagattcaaatagatctgggagaaggatgctgcctgtaagtactgctgtggtgacatcaaggctcactggggttacctcagtctgtagtggtatttgcataaaaaagcagtgtttccacatgtttgcatgtgaacagacttaccatcatggtgcagtttaccacctctagtctgttgttctgtttgagtcagtagcattggagaaacagactaacatatagggtctacaaatttgtaatatttttcaagtcattataaaaataagtcataaatattacaaatttagtggccacagataaaattaatactgtttcaaggaagtgccaatatgttagtggtaacatcatacaaatacccatttgtaatgacaagattgtctcatcagtaactgctcagtgtccacgctgagatgcctatatcaattggtgtttgcatgctaccattgagaagagaattacacaccaagtcaataaggacatatttcaaaatatgtttgtatgaaaacatcacaatacaaaccattttatatatcattaataaaagtaaatacaagtagaaatttgctatatatcctaaagaagttattaatatgagaagagataaaaatgattttcataggttaaaatacttctaagacccatcatatactttctgagtgaatggcatctcttgtgtgtcagcagtcagactttgactcttttttttaagatgctcacaattacatgctgctctttatctttttttgtggagtgggctcccaaagtccatttgtatgctaggatccactaccagaggccccacaggtgcccaaggcctcctcactgacccccacattcatggggtctgcatcagttctatgctggtttcccagctatcagtctggggtccatgagcttccccttgttcaggtcagctgcttctatgggtttctccagcctgatcttgacccctttgctcatcactcctccctcacagcaactggattccaggagatcggctcagtgtttagctgtgggtacctgcttcttccatcagctactggatgaaggttctaggatggcatataaggtagtcatcaatctcattatcagggaagggcatttaaggtagcctctccactattgcttagattgttagttggggtcctccttacagatctctggacatatagacattcaagttatatttaatttttcacattttcttgagaatcttttttaaaataaaattatgtgtgggtactacattacaatcattcccagcctttcttgttgccttttccctctcattttttctttaaaaactgcttatacacacacgtacacacacacacacacacacacacacacacacacacacacacacacacacactctgtataacatgcttagatgatttaaggttgctcatacgtatatgtttttagtgcagataactggtattagataaccaattaggagcctagatttgaagaaaactgagtctcagcagtcaataatttcctgtaggtcttcatctagggtttatccttatgatatttatctagtccacattggaatatcaacctggtattgccaatttttagttagtctttatgtagccatagggttaagagtctgtgagtgcagcttccatattatatgcagatctcacaggttatgttgtggttttctggctcttgcaatatttctacctgttcttctttggttttccccttagtcttagatcctggatttcttcttcttcattaaggtgttttgtgaaagtattttatgacagcaacatgaaggaaacttgctattatgaatgtcttctaaattatgtttactgtactaatgcgctgagatagtagaaaagttgatgtttgtttacctttataggagatgaagctataatacagacagtcagctattttggtagcttcattattagctcccagttcttaaaaactgtcaatctacctaaaattaatatttcttttaccattctattctttttctaattttagaagtataacaacatagatcacaaatcttcacagaactgaatatttgatgagaatgcattgcagataaatgaaaataaaaaatatctcttctggtgaaatgtgtattgaccaacctaaggtttttccagtggtcattgttgcttggggtgcatgttgttctcagagacttgatctctcatccagagctttgatcttcttggttgagtagtatgtttttatgcattatgtcctcattacagaaaacactcttgcacatcagaaaagcagcccagtgacaagtccgcctttcttttggtgattgttccatatggctgggactgaaaagactcaaatgtgttcctcattgcatgcacatttcacagtaaaactgccactagctgacattctgattttaaagatattagatttttatgtgtcctaatttttatctaatgttcacactgaaatgttcttgtgtttatataatttactgtgtctagttaagcaaaagagagctgtattggccacatcagaagggctggtcctacctatcttgaccatcatagtagaggtttatttaaagctttgtttccttttgtgttgcctatggctgtaaaaaggcatgaacattaatcatgacattgactaatggctttgcctgcttcatgatgtggagtagccatcatgactgtatcatttgatagaacttttatctggactggttgccttaataattgaaagaaaaactttgtcttagcatgatatgtgcaaattaaaacagattacaaaactctcccttttaggaagctgataagttccttgttcaatagttacaaaatagaagaagaaagataaggaggaggaggaggaggaggaggaggaggaggagaagacgaagaagaagaagaagaagaagaagaagaagaagaagaagaagaagaagaagaagaagaagaagaagaagaaataacaacagtgattgacatattgtagaacacctgaatttattcctccctgatttctctctggcacagaataaaggttctggtgtctataggggttaacaagttgtttgaaagacattaaaagatttatcaacaaattaagcagttctctgtatatagtggtaaatgataaatgacaactgaggtatatgttcaaattaaagtatttaaaaaggagttaggcctggagctatggcctagcagttaagggcacttattcttgtagaggttctctaagttcagctcccagaactcagattggacaactcacaactgcctgtaacaatagttctaaatgatccaacaccttttcctggtcttagtggatagttagaaatcatgagccaactctaggaagtcttccagagtggtttcataggttttcttttgtgtttcaggtaacaacacttgtcaatacaagcaacaaaggtccatcaggtaaaaagaaaggaaggtcaaagaaagcccatgtgctggctgcatccgtagaacaagctactcagaacttcctggaaaagggtgaacagattgctaaggagagtcaagacctcaaagaagagttggtggcagctgtggaggatgtacggaagcaaggtaggtgaaatagcatgatgctgatgctgagggttgctgcatgaatgagataatattctttagactcaaaggaattgtttaccttgtttgctctctgcacatgatgtttgcaatatttgcatacttattttgatgttaaagtgtgggcatggcttcaaaccccatgcttttgccgttacttaaaaatcttcctattgcttgcccttggtgaatgaaaacaaattctcctatctaactcatatcttggtatgaagttggaagatacggtctttgtaaaatggcccaaaacccagtattttaaggaggatggaaagcaggatgcaaaaccaggtagaaaaaaatgttccatgtgattctctaataatctttttagtccacagcttttctcacacatctatatagttaacatagagtttatttggcatttgaacattttttcattagaaataaaatacaagtaacataaaattaacatcaaattgtttttaaggttcatgtacagtttagtgttggtaagcctaggcacatctttgagaaacttattactagacctttttcatcttagaaaagtaaaactgtatgcattcattcaactattcatatgctcttatcaaagtctctgtgacacactcttcatctatttgacaactgttgatatttcatagaagtgggatcctgtggtatgtctttttctgactggattatttcattaagtacaatgtcttcaaaaaccatacactctgtggcatatatcattattttagctttttattactaagcagtattccatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactattttgctcttgtgaacaaaattattattttattatacttaaataagtaagcacatatatgatggttaggtttaattgtcattttgaaacaacttaaaatcacccagacaaagagacttaagagattgcatatatttgatgctctgtaggggatcaccttaactaaattaatgggtgtggacaggccaagccttctgggggcaacaacattccctaggcagggcatcctgaactataccaaaaatagaaatgacattctatcttaccataatgtcaattaatagttcagaagcatatgccgaaatatttgttgaacactgatgtgtaatatctaaaggaatgtttcattaaatacttaatgaatgaatggtccatttatattctttgtgctatcttactgtcttttgcagttaatggatggatgtttagcatcttaaattaaaaccctttcacacaaacacaaattttctccatttcttgtgaatatggcatacagatgtgtgtacacattctttgccgctgtgtgggcacacgtgcacttcatacctatgttttgggggcacaaatttgatgtgggaatcatcctgtattgatttttccaatttcccaatgagacaggatctctcaatgaaacttggcctgtgttgatataaccagcctttcttatcagcttactctgtggaacccttgtctccaaattctaaggctgtaattacagacaggctaccacactcatccaaaatttacctgggtttctggagattataattctagtcctcacaattttgtggtaagagctataaccgctacagtgtcttccaagttcctgaccaatgccaccattctattgccttcctcctaaaagttaacttcatgtttatgacactgacccaaattgttacttctactggacatatgtattgttccatatttcaccttatgtgaagagagcatgagtgtatatgtgtcccgaaagtatgaatgcctccatgtctaaaaccacactaggaagctggtgtttttctggaagtatggtcagacacccgcttgccttcatgcatctgtgctctagataattactatttgctgttgatttcttatgtatactaatgtgcacaagtaaaaaatgcaaggtgtgctcagtttgacaactgtttgcaactgtgaagtactcagtgttctcaaggttctacacatatttacagtgaagagttttggtctctctacctccttaagcatctgtcttttttactaataaattttcctgtttagtttccatagcaatgccttaggtttctctctctctctctctctctctctctctngtttctctctctctctctctctctctctctctctctctctctctctctctctctctttctctctctctctttgttagttgcagtatttggatcttgatgcttggttgtcatgaggttcatatgaaattgtctattgtaactccaatagaataatcaattggctagatttccttggtggtatgagaatataagattcttatttaggactgcttacagtggttgctcttctgagaatagctgattactttgttacagaattgattcttatggataacatatctgaagaaaccctgagcccatattttccttttcctgaacagtgtcatattcaaacacactttactgtaacatgctaagtaacaaccaaagtattaaaaagcttgcttaaaactcccctttgcttttgtgtacttgcttcccatctgtcagagtgtgcctctttccaggcaatgtagtccattactgtgcctgcagattttcttgcttcctttctccctttccccaatgacagttcagctctttcttcactgtgtgatttcctttgcccatctggcttctgtcagttttcatattggctctttattccatctttttgcacaatgtatagcctgagctgattttcagagtgataaaaatgaatgaacccatgagaaaaaggtgtggatgaggttgggaatatttagttatttgacatctaaaatacagcagcatacctcccattgtagaaatatatatgtctttaataacatagaagataaaatttatgtgaccatttacatttggaggtaatagtttcttttttcaattttttcttcaatgtccatgtatgtatactattttattttctctggcattgagattgattctaaggtttttcccaaactagacaagtgatttacctctgactttcagttctcagtcttgattttgtgttctcagataaaatcttcaaagcattttcaccttttttttccagaatgaagagaagagctttacatggccatttttagatttctggtattgagtcatttaattttgttcatttatagcttctgggtgtttgtggttttaattatttaatctaataaatttatatgcaaaattatgcatttaaagtatttactgcctcttaacatggttaaatttactgttgtctcaatttatttattacctcttcaaaaattattatcttctcaaatctaggatgcatgcctgatgttcaaaagtatccataatgcatgctaactatcatttaaccatagggtattctgcaagaaaagcgtactttcaaattacaatctgtagcgtgttctttgaaaaaggctatgatagtgtatacatgaggaacatgtatcaaaaatgcattttcaaaattcatattatattcctgtattcaaaacctggaattctgctgacttatgcttggatgaagataacatttccaagtgtgtgtgtgtgtgcgtgcgtgcgtgcatgtgtcaactatctgacttttatcttaaataaaatacttgagttaagtgtatcagctaggtttgaatttcatcagcctaaagacagtgattattactacactgtcttatctagataggagcttgatactttaacacacagtgagtgatggcaaggacagaggctgtcttggttaccattcaagtgttgtgacaaaacacataacaagtttcctataaaagaaagtatttaatttggggtccatggtgcagagggttagtccatgaccatcattggtggcaagcatgcgatcaatcaggaaggcttggtagctcaaagatgagtagatgagtagctcaaagttcacaatagacctagaagcacaactccgagagggacactgcgattggcatcagcttttgaatcctcaaaattcaccccagtgacatagcatctccaataacatcatactttctgattgtttttaaacaggtccaccagctagtgcattcaaatatgtgagccttcagcggccattctaattcaaacatacacagaggctttcctgggaaaccagtagatatgtagaggtgtggttaagatttcaaattttaatattactttggcaaaatacctaaatgttacagactaaaccacttaagtatgtttagaatctggattctccagttttcagatgcagagagagaccatgcttacattaggtggttgttttcactcaaagaagtcaaaggaattttaaaacttaggtgtctattggaggaaatgattcagcacatataaggtcttgccaccaggcctgggacccacatggtagatggagctccatgaccacagcttaataccctggtgtatgcttgcagatacacacttaaatgccacagtagatttataagttatattttgttgacttcacctgtatctttgggaattgctctcttactcgattttctttttggtgagccaatgaattcagttgtggttccttactggagaatgagtgagagcttatttgcagaagcataggcaacttaccaatggccacaccactaaataaaatgacttttcctctcccagtaaccactggcagctggtagacctcatttcctgtctaataactaacaagcctgaatcctctcaggcagactggtagcatccagtggtctttctgaagactggttgtgtcttcatgactcagagatggtgggagttgtgtgtagaccccgcatgctacaagagaatagatgtatatatgaagcacacatagcaaaacttttcaaaatcagagaaccaagacactgttataaaaatacctctacattgatgtgcccagaaagcttaaaactgatggagtgtttaccaccaagaccttttgaactgaaagtacatgtccaactcctgttagtatcagaatcatctggaaggattttaaaagcctgacatctatttcctgctatgattcctggagtatgacctgagcatggtgtttcaatctccaaactggatggctctgtagaaattatttctgaacaaatagactaagtttctgattctgcattatgtgcacatagatgctcgatggatcctgttagctggagatgcaggtgactgatgctaagtgtatgtgtttctcaacagtgcctgttttgtcttaaatatttcaataagtactcatcattttctcaagaaacgtttaaatatcaataatattttgccaagcttccaactttgtagtttatttagatataggtaaataaaccttatatgggaaaatcaacctgatactttacaataaatttaatggataggtaatgtcttatgatggaggccttcccaatcatgatgtactacagtctcttagaaaatatgtaataaggtatttagcaatcctgtctatgaggcagttaaatattaaaggagtttcaaagaaaagaatggtatactgctgatctcatttgatgagcagttttggatgcaggtgcaatttcagctatgctgagatggtggggagggtcaagactgaggaactttggcaactaagattattatacacaacataattgaaggaagagagagaggaagacagaagctgataagtagctgcttgttacctccataggggtatgctgaaagattaacctgccaagtgtggtggtttgaataagaatgacccacttaggctcatataccccctgaatgcttggggagtatctttaggtgatatggccttagtggagtaggtgtggccttattgagggaactgtgtcactgggagggagtaagctttgaggtttcataaactcaagccagtcccagtggaactcttcctactgcctatcattcaatgtggaactctcagctgcctctacagtgtcatgtctgcctgtgtgctgccatgcttcccttcaagattgactaaacctctgaactgtaagccagccctaatcaaatgttttcctttataatatttgccatgatcatggtgtatcttcatagcaatagaactttggccaataaaaagtttataaaaagttaagtgaatcagcatacacctggcgcagacatatgatttttgtgtagttaccacaggaaatgaagctaaacaaaagcacagtgctttcaggatccacgactgtggtggaagccacgggaagagaaacaaaaattgaatgttacaagcatttcagaaaggagtcaatacattcccatttattgaaaggaaatgagagtgaacatttgctcttgtgtggccacaggcaacatgattgggaagacttaaaggacagcaggaccagagttgaaaccagtttcatttaagacattgataaatgaggagctctccctagcagatggtgatgctgtagggatgggccactggtaaaacaaggagatttgcaagtatctgaagttgatgaatgaatatctcagagatgtaacattcctttgagtaagtgtactagataatgaagagggaagggatgactgtgcaatttgggaagaaagtccacatttggaattgagaattggatataaataaattagaacaggaagctgctatgaaatgtgaagataaacaatatagtcataaaatctgaagaaataggacttttaataaaggagctagtgatctatctgtacccctaggatgctgtcagcatgtcgaatttttcagatatgacagaccatgaacacttttgattttgcaagaaacgtgacatctattacatttaaaattgaattttcagaaaatggcaaaaacagtagtcaaaaagaaggcatgtggaggatatagaatatgatgcaggggagggagcctagccaaataaattagctgtaaccataaggaaccctgaaaacctgtaaaggaaggtactattgaccttaggtgcctgcatgtacatgcatgcaaatgcacatacatacacacatgtccacaccattcacaaatgaagtgccagagcagggagggagaagagaaggcctggggatagatgctcaaaagttagagtagatggtgtaataattgagctaggtaaaaaagataagtagacttgcctgtattgctcttgaactatttctatacttatttttgcccctgtagagagtttgggacagagctgattgactgtgtgctattttgtatcttttggggagaggaacacaatgcctttcacacaatggcatttaatagattcattgattgattaccaagggatggcaggaaagcaatagaagaataatggagaaacattaagagaaaacgttgagtataattgtttccttgtttatatcttatagcctaaatcaaagagagaggaaagccataactgcaaacataaagggaaagaactcaactggtagcaacataaagatgtcttcacagaaaaatcaaataaaaaggagagaccaagtctagagaggctgtgcagtagtcgagaggcaacttagtagatatccacagcacaaataaagctggacccagatggactgttctgtaatctcagagctcctgtgacaagatggtgagaagagacaggagaatccatggaagctcacagcctgctaggctgtgtaagtagtggtaaatatcaaaagagagaccctgtgtaaaataaggtagatggaaaagacccatacctgaggattgtctttgacttccacacataagcacacatcattgtgaactcatatgcaaatgtacacacagcacacatatacacaagtcttttatagaatagatgagttgtattcaccaggttaattatctaattctttttgaacaatgagagaagtggctttaataagctatggatacttgtttggagaggtttaatagatatgtttgttgttggcaaacaacaaactctcccatctgatttcatttcttagtttgctaaaaagaactgctttggacattgctcctttggacattgtagaaaatatcaatttataagaggtttaatcatcattgtctgagaacctattttctttgatatgtaacagcatttctagaactttcttacatttgaagcagactcaaaaactgtgctttgaatattaaaagtcatggttcttataattcttttcaatgtcaaattcaattggtggttcaacacagtctggttctatgcctcagcatttagaaaagtgtaaagaaccccccttggccttctattattacatctccacttcctctgaagccagggagtagtgtcctggatttctttccctcaattcacacctctgcattcttattaaccactctctgtttgggcaattacaaatcaaaagcattaagaaatttccctgacatcaatagaatatatatcaagacatatgtggctgggcccctgcattaatggtaaagtcttggttcaaaatgatagaggtgcaggtgaaaaaagtggtgtattctttcatggagccaatttgtaaaacaaggtgatggcacagcatttaattagtcttgccaaaacccgtggcttttctctagtttgacctaaactactaggtgaactgatagattgatgtcaaatagctgttttatttttacccattgaatacctatttaataactattatccagtgggtgaaatcacaggaagcaaaacagaggaagggagaaagaagcccttcataacctccagaagatatacaattgcctactcgtcacctgatgactgtctcacttcttgtttgataaaatcacccacgtggaaagagatggtggctgcaatttcttcatgggtgtctgatgaggctgtctcagaaatggtatattgccaagatgctgttcttctttcatgtgtcctttttctcttgtgtgttgagcttcaacttttcatactccggatgctggtgtgtgcttgctgacatgattgagtacccttgtaggtatagtgcatcttcatatgtctagagtgtgctcctcttgaagtggtgtgagattccctccttttctggatgggagtgcagattccattccacaaagttcatatctttgaacttagatttgctgcatgtaaatcagttattctgaataaaattagcttactcaaatagcatacaatgttttgagaaatctttgtgaaattggttatgaaatgctcagaaatgttcaagcctcttacatgaatagcacacacagtgctttacatacaacttgtgcatgtccctcttcaatgttcagatactttttatagcagtttggtgcccaatccaatgtaagccactgttaggctgtgttatttggggagaataatgatgataaagtagactatgcatgttcaatagaagtacaactaatctcaaatgattttcagtgttaaatctgcatattctaaagctttaaatatggagtatcaactttaatataggaaaatagccatgcataggagcctagggcagacattgaagctgagatggcatgtggctccttcttcaggttagacattgaacagagctgggatcttcagatgcaccactatagccatgcaaacctgaagctgcctctctgattacagactccttcccttgctcatagagtcatcttgttacagctgtttctctgtataaagttcacagacagagtgtttcagaataattgggatatgacagaaatgtgtataaaaactgagtctagagcttcaccatacttgggtttagaatgcatagacttccttatttctgggtggtgtctcaagtggattctaaggctccgccttttgacattaacaattgccagagcttaatgcatatctatgactgctaccttttgttcaagataatttaaaaattcacttatttttgttgtttagaattccatacatgaatatagtgtgttttgttcaaataccaccattaactaatatagatctttgtgtgtgtgtgtgtgtgtgtgtgtgtgtgtgtgtgtgtgtgtgtgtgtgtatctatgtcttgtatgtttgcaagtgtggatgttcatgtgtagggttgcacatatgtgcaggtacacacacacacacacacacacacacacacacacacacacacacacacacacgtgtgtgtgtgtgtgtgtgtttacaggccagaggtcaacctcaggtgttattccttagggtctgtccacctttatctttgcgaaaagttctctatttcctaggagctttctgatttggatagcctggatggcccggaaaccatttgcctgtcttggtttacccaccacagtgattttatgtgtgtaccaccactctcggttttttgtccttcactggggatgctggggtagaactcaggtccttatactacttgcatggcaaacactttccaagcccagtgtagcttttatttccttttaaagtgatgtaatcagggatggaggtaaagtgggagtttgagagtctagtgaaagtttcaaatgaatagaactgtgagctttagtctccagaacagtaaacaaagcaaagcaaagcaaaaataagtcaaaacctcagaaagaaaacaaatatcagcaacccaggctgctaccagatagggaaatcacttttcagaagcttttaacctcagaatttccaaaagaaacccgagtatgagtgcaatgttggacagataagaggaggatggatgtgaaagtatcatgaaagaaccatccctgtggaaatgccacatgtctttgaattcaccttaatgcaaatattaacattttctaggattttaactgctgcgtattttattaaataaaacactttgtatgtcacctttgacttagttcaggacccagatgtgttccaggtccacagagttcccttgttgtaagagagtttgagaaaactgtgattattctttcacttcttcctctttctgggacccttggcttttggaaaggctgcaatctttggctacaagccaaaaaagatgacaacattgactccttcttatttactgatgctccatttgtcagctgctgaatctgttttctcaacatcattttgctagccatcaggaggattacttgccatatttttttagtcagccactaaatatctatcagttattctgatagataacccgtgtataattgcccaaagcgtgtctaagtgttggattgttataagcactatcctgtgtgctgagaataaaaacacaacaacaacaaaaaaccaaacattctttgcctgtagcaattttgcactcagagttgagacatacaaattaataagaaaaattgtgtaggttagtgatttccaagtgtataattatggtttgagaaaaaaaaaaacttaagtggggcttactattaaaataaaaattaaaggagaagacaagatggctcagcagggactcttttaatggtggaaggagagagccaattgcacaaaactgcccacatactaagggcacttacacccccaagctcccattcgtacatcatgtacacacacaattataatatttttaaaaaggaaaaatctgtgctacatgatagaaaataaatttaatatataattaataaaagacacactctaagaggaaatatttgtattctacttctctggtgaaaggctttcacttgtaatacacaaagtactcttaaaatttaacaatgataaaaaacaacctaattcaaaaggtaattgaacaatttgaatagaaaccccattagagcagatgtgcagacaggaaataagcatagagaataacacttccattcttgtgactgaggaaagtgatgcaaacagtgagattttactttacaccttaagatctctgaaatgcgttgacacacatatggcagagccatggagtgaaagctaattcactccggtggtagtgagatgacataaccatgttttctttaatgtttactggcaggtttatgaaaaaaagaacatgatcatgaaagtggtacagccctggatattaacttcttgagttctaaatacttctgtacatgacagtacctatacatgtcccattttttctacaaaaatttttagaataattttacaattacagactttgcaaggacagtactaaaagttcctatatacttcacacccattttctgtattagtaatacctggcacccttgtggtttgtttgtcacaatttatgaatcagtatcagtgcctcaatacttgaactgagtgcagcaagaagagggagcacggtaacaaactttgggttgagatgcacaacacaagtggcaagaataaagcaaatactgatgagtttttattctgcagctgacttatttgagtgatgcatgatgaaaagtgatgaattagagatctgtatggatacaacacagagatctcatttagactaaccccggtagaggcctatttattctaagcctctttattcagataaaaaatgtcagtatgttatattgacatacacacaaaaaagtaaacatagaagtaagaacaaagtaagaacaaaaaatgatggaagtctgtggacagcagtagagaaaatcatggtccaagactgggttgtaccaggaaagtgcttgaggatcacacagatggtggaagacagttgttttctgcagagccatatatcctcagagtgtagcaacggaatgggcagctttgctgtgggcacattttcaagttccaggtctttcaatttccagtgtgcccaagctgtgtgatttggggatctggcttctctgagttagggttttcaggagctcattggcatgcccagtcttacatacaccctaatacactaggtgaagagtagcagaatggatcttagaatactgcagtgtggagacatccagtggcggggtccttacctgaaaatttaattctggccgctgctctttctgcaggattgcttgtaaagcttgttcatgataaaatacttcagtatctcaggtagaacactcactcaatttattttcatttgaatctcttcttttaaatgtaggttgttgtttgttttgtttctgtagtgctaggaattgaacctggagcctgatgaatgctaggcaaacactcccacagacttctttctcccaaacacttttactccatctgcaattccccttatttgaaggaacgtctttaagttgaccatctgatcccaggatacataaaagaaagcaacctgcattagcacaaaaagaaatttggtcatcaagggctttctgagtaagctcagcctgtaattcaatcaaacaatgcatttgccagagcattgtgactaacggggatgcggtttccaagataaagccggctcactcatgcttccctaattatgatctatgccagtgacttgatataagccagactgtcttcattagctcccccctctgaaagggagacttcagtgagcatgcttctaaattagactgcttttagtaagaaaataaatgacacagggaaaaacatactcctcaatccattctgtgttctgctaagtgcttgttaatgcaaagtccccaaggacccccagtgtggatagacatagagtcaatacaataatttatggagaagccaccccagctttgcagggctggggaggagtctctgtcttcagaagctgatcctgggcttccagataaaatagataagaaatgggtaggatggagttggaagggaagctcacctccttttgatggtcctggcaatatatgcttattttcctgttccctcagttaaacagaataaaagaatgttgtatctcccagttgacagacctcatagagggacttttggcattttcctataccgtgctttcgagaactctatttagatgataaccttagtctcaaatttccagtgctttcattgctactggagcagtgcagaaagcacacagttatgttgtatgtgaaggcatatggaaacccttgcctaactcatgtactggtattataggcatgcagtgcctctactggcttctatacatgggcactccaggtctaattcagttatgcatgcttagttagcaagtgttttactgactgagctaccttcaaagctccttcactgcctttgaagaatatttattgtatttttaatttgagtatgtttgtgtgactctgtgcagatgttaatatgggttcaggtacctgtggaagccagaaaagggcatcatatcttctggaatggagttacaggggattgtgaaccatttgaactgggtgctggaaatggaattcagctcctgtgcaggatcaggaagaattcttttttattattacttttattttgcattctaaccacagttttccctaccacatgtccttctgccccccttcacctcctccaacccctcctcacctctcccacagcccacccccagtctactgctcctcacctaagggctcccatgaggagtcagcatagtctggcacaatcggttggggcaggggcatgctcctcttccatgcatcaaggctgagcatggcatcccaacatagggagtaggctccaactagctagctcatgtaccagtttctatcatagtcctactgctagggagccctcatctagtcaaagcttgacaaccatctcccacatacagatggcctagttcaatcccttggagtgtccacagatgtaagtctagattcatgagtttccatgagcttggttcagctgtctctgtagatttctccatcatagtcttgacctcccttgttcgtctattccttcttccttcttccttctcttcaactggattgtgaacacatgatttttgacaaagaaaaaaatagcacaatggaaaaaggaaaacatctttaacaaatggtgctgacataactggatgtcaacatgcagaacattacaaatattttcatatctattgccatgcacaaaactcaaatccaggtggatcaaggacctcaacataaatccaggtacattgaacctgatagaaggtgggaagtagcgtgacatgcattggaacaggagaccacttcctaaatataataccaatagatagaatctgagagcaacaatcaataaatgggacctcctgaaactgaaaagcttctgtaaggcaaaggacactatcagtaagacaaaatgacatcccacagaaggggaaaatgtcttcaccaactccacatctgacagaaggctggtctccaatatatatccagttgcagagaaggaggagtgatgagcaaaggggtcaaaacctggctggtgaaacccacagaaacagctgacctgaacaagggagagctcatggtccccagactaatagctgggaaactagtatgggactgatccagacacccatgaccatgggtgtcagtgaagaggcctcggaaatctatagggcctcttgtagtaatcagtacttatcccaagcataggaaaggactttggaagcccattccacatagagtttcctcagcctagacacatgggggagggcctaggccctatcctaacggatatgaaggattattaagaacccccatggaaggccacacactccctggggagcagaaatggtatgggataagtagggtgttatttgggggtaggggagggagagagaactggggttgacatgtaaaacaatcttgtttctaatttaaataaaaaatgggacaaaaagaactcaagaaagtagatatcaaaatacaaaataacccaattaaaatacagggtacagatctaaacagagaattctcaccagaagaatctcaaatggccaaaagacatttaaggaagtgctcagcatccttagtcatcagggaaatgccaatcaaaaccacacagataccatcttacttctgttagaatggctaagaccagaaatactaagggcagcttatgttggagaggctgtggagttaggggaacattactccattgatggtggaagtgcaaatttatacagccattttggaaatcaatatgaaaattgggaatcaatccttaagacgcagagataccaaaagatgctcaagtataccaaaaggacacttgctcaacgatgttcatgcccatctttttaaagcctaaaaaaacagtaatattgctatttaaaaaaaacaaagcatgttctgaattagattgtgctgctgtttgttgctctgtgtgccgattctattgtagagctccattatggattcttagaggagtatttatgggatgaaaggccagaagtattaaatatttacatccattagaatgtgatcttttggtataggcagaagggagaagaattacttggtttatttccattcacaggctttatgaacttactgcttgggtaatttcttaaatgtcacaattaaaaatattgacctatttctctatgggctttcattgaaatggtagcagtcatctctaatgttacctaataaatttaaaagatggtctttaaattgaaacatatcatcactagaatttccccttttcaatcccagggctctaaatagccaggaatgctcttcttcatagattaacatcctgagagctacaacatgaacatgatgtctttgtcttcttcagtagagatagacagagcagagcatgcactgtgttgtgcttttctgaaacagcatccttttacctctgcttttaaattctcatctaagaaatattttaattgttctctaatatgtctttaaatttttctctggtgtgtgtgtgtatgtgtgtgtgtgtgtgtgtgtgtgtgtgtgtgtgtgtgtttcaagacgaagagggcaagtgggttgcccatataaatacaaaggccagaatacattctcagttgtcatccctcagaagatatctatcttccttcttttagacaggtcgtctcactgacctgaaactcattgaacaagctgagctggctattcagagagtcctagaaatttgcttgtgtctaccacatcagtgctttgatatttgtggttttgtgcagagtctagaattaaactctgatccttgtgtgtgcaaggcaaaaattgtcctgactgagccatcttttcagttcaccatttttactcttaaaaatctgcaatccagttgatcaatgtcctatataagtgtttgttcatatagtggtagaaggtagagttgtcatattaatattgtgtaaatcacgtggtcatccagggtgtatctccatggaatcagaaggatgaaagttagcaattggctggggcaaggcttttgtagcccttatagaggggttgcccatggttcagaaccaccacacttgcccctgcttcctcagcaagtgagtcaaaagagtataatgagcctttgtaggacatgagtccccaaaagataaccaagatgtgagggacccttagctaccatgagaagccagtagatgggtcagaatgtctcagtgagtccagttttagcatgggggagactgggtttaattacttaaattgtctaatcttcatccagagacatattctgtaaggatatacactgcagccacatttctggtgattctcagctaggacagaagctctagaccagtcattccagggacactggatgctttcttaatgtaatatggtaggaaagccattcattctgatgttagaagtggctggctacaggaaactatgtataacctatctctctagtttgatgggtttatctgtggattatgtaaaatgggtagtacaatagtccctgtattccaaaacaggaggaacccatccaacatgacctttgatggagaggattttgccagggctatggatttggagaagtccttcactgctgttagacatactgattgacagaagactaaatcttaagacagggtctctttgtggctcctcattttacaatattagagacaccatctattagttgttgacatatactttgagtctcaggagagaattcagcaaggttatgtggtccataataggaagtcctgttatctgaatcaactacaaacattttgtgtcatgagaagccctggtatcccaatcgattacaaatattttgtgacaaaaagaatcttagaattgactggtagccagattcatgtgattttcatctggtaggaggtcaggggcaggaatgtcatcctcttccacatgggatcaacagatgccagaaccattctcagagtgagatttgcaactttcatgactatgcagaaagtatctgctgatctattaaaagcccaacacaaggggatcctccaaagaataattttatctattgtggagtaacagaatattgtaatgggaatatgagagccctaataaaatgtgggtgtagtcaaagtgattaaggtgaggagatgctccaaaagacaaaaatgactacggctggtatttaaatcacaagattggcatcaatgaagtttattggactagtgctaggctttgatttgcttagtttgttggtttatttggatatgttttattttgattttggtatagttagtgttgatagtgaatccttttctaattctgataatgtacacatttctttcacaatccaaaatgtcatctgcatgtctgtaggagacatctatgctgcaacacttacagattgacgttttctgctttcagtgtgcttaatgaaaagaaacagtcttctgcccttacccttctatcatttatatacttttcagatcattcactggtttccaaatctagacatgtacatgtcaagctgccccacagacactgtccaatgcttagtatccaggattattggtgacccagaatgccagctgtattacaccccagctgggatctcaaaggtgtctgtttggcttgacctccagtaaatagtgaatgtgtaaaagcaaaagttcttctgcagaaaattctggttatcatcaaatgggcataaatagaagtttcagattgctgttttcagtctctgcccctgtctctgggtgatgcatacctggggtaactatctctaaaagtgatggaaatgaaaagataagagcaactcagtctgtgaccctgcctccttgatagtctctcactataagttctgacctttcctcaagacctaaacaattcctgatgtttcccatcttatcttagttctctaaatacagtaacactaaaagaaatattttgttgttatctagtttttaaaatgagttgcttcacctacaaaataaaattttaaaaagcagagttaagacaatttgttcagccctgtggatgaatagtttttaattatcaatcagaacacagtttggcccctgaaaagttttcattctcattgtaaactaaagatactggggaaaacactggaacagctgtcagtcaacacaagggtatcttcaaaacaggagcagttccctctggaaaagctttctcaactttttatattaacattgagaacacactatcatgttatttactagtctcagtctgatgacagtatgtggataacacatgatttttattagttttctttgcaattctgagagaaatacccttttttatgaaacaagttgtggattaaagatgaaaatttatcaagcatgggccttaaagataacgatgaaaagttataaagcacagcttgaagggcaatgtgctcacttctttcatttttccagcaggatgtagttaaaattggcattttccacattcgtcgtctaggtttgtaatgccgagattgaaataaatgtcatcaccagagcactagaaaaccctcctctcttttgttctatcatgtggggctgtcacaaaaaattacatactctgaaattagcaggtattttttaaagtttagtaatgattctcaatattcattgttcaaatggcaagtactaatagcattttatgttgccttctctaaatttgaaatgagtgtctcctatctgaagaatagcaacatacattacaggtgtcttcagggataaggataaacattttatgattagataataattaattagatgtatcagaactcatatgtttgtgtcccagttattttgggttcttatgtctttcttttatatgcagatgtttagaggttacccagctgtttttcacattttggtgattaacagtaaacattataattcggtcccttccagttttctacttgctatttatcaagtctttatgtagtatttcagactttaaagaatcactgatttgcatttctctctgtaaagatgaagttataagctccacctggctttccaggtataaaatgagatcgatgtggtcatatatctttcctattttgctgaataattcatctttatgttcttcttgcacagaccctgatatttttctttcatgaggcagcaattggtttggatttactgcatactttcattccagcccctttctctgcagcttttcttctattgccttttccatccagaaaaataacactttgggtgcttatgagttgtgtgaccattttttttttaccctaactatcaatattgtcatttcatatcccatctctctctcttttatctcagagggcattggaagagaaaaggtaggttagacataaaaaacattacttttattttcatatccttttctaaaatctctaggtagtaagattattcttatctctgcattagtcatcttcacacttaatgccatctaactattccatctatcagctttgtaagaaactcacagccatagtcatatgaattttatcagaaaatgaattggaaggtggtcctgtgtgctaaagttctgaattgaaagaatctgcctcttataaatgtctgaggccatggtggtatatagcaggtgacaacttgtgctcagatgtcaacccaccagaggaatgattttctgatggaggaaaatcctgttcaggaaaggcttgcaggaccaccaactctgtaaagtgtagctcctgtctgtaatttcaaatgtgcaaaagcagctatggtgtctctccaattcctgcactttagtgtgtaatctcataagatatggatatgcaatctcatgacttcatctcagtcttatgggcacatatatctgtggataggcaggaggatgacttctcattaattgtataagtttggtaaacagaacatatattaggatatgcttcataactaaatttattgttccacaaggacgacaagacatttaaaagcctggattgttccttttattcagaaaacaataatttctccctagtctaagacaaactacacacagttaactcattttcaccttagagcaagttgaaactagacttaatgtttctgtaaatggatcataagttaagaactttacagatatgcacaagggcaaagtcacagatgtctaatcaaggttattaacacaaagaatcctaaaatactatgccaatttctttaactaaacttggctgataacacaggccaatgcccacttcctactaaatttcatggtaatttgcactttacacgaatttctaatctcagtttatgatattaaactcaaggttcaactaactaactgtttattgtttgggtcccagataacaattaatcaattaaccaagtccaaagaaaattaatctgtgtccagctactgtgggtcatttcacattagccagggcttcaaaggatggtctgtccttacaaccaaagttacaagatatccccacttttatgttgtggggctacaaacaagataagaggatgttgggtttggacgtgttcaatgccactgtccaggaaggtgccaagcagcatgttcctgcctgtgtgttaccatggtaaatggctctattccttattgcttcctcaggaatgtactttgaccatgagatgcaactctttttttccattcatttatttagctcataaataaagtcatgcacaattatgatacacaatatagtatgttcacaatggcatggctaaattaaaccaattaacatgttatatcacacatattcatcatatttgttttgagaacacttaaagtatactatctcacaacttttaaaatatagcatattgttatcaaccatatttatcatgctctcagtagacctcaagacttcagagagtccatgcctcttgtccaactgcagttttatatccttaaaccaatcatttcccaattgttaaaagacccacattgaagcctaactcttatagtctttttttcttattgcctcaaaccatctgtaaaaaatgtatttaagctaggtgaacaaagaagcaagggagaaattgaaagagagaattggaactaaagataattagagacaatcatagcacaggaattatagctgcagaaaaataaagaaaatgaccctggaatcatatatgtaagtctttatccctcagctaaaaaactgtcaagttcagttttgctacgctgtggaccttcaaaacctattctctttggctacaataaagaaattgttcactagatttcacagctcattcaagaaaaatggggccacactgtaacaatccactcttggtattatttaatctgagtaccaaatccatgtgacccatgctgtaaaagtctgggtcagctctgtggtacatgcaactttttaggaattgggctaaatgaacaagtcactctttgcctccactctcttggtgaggactgggaaaagtggctcaaggacaaatggacccatgacctctctgaagagacacatttgtatgggaagcttgtgtcttatgctgtcttagaggaagaggagtaggaagggaccttgtgactttctgcactaattcacacattactgcatggaaaggaaaacttggggattattttttaaaggaaacaattaatggaacaacttagggcccatttaaggtagcaatatctggaaattacctttgatttagtaatcaagagttaattttaaaggatattatctcccaaatttaaagataatgcagtagttttattttacttataaatcaacagtatttttattattttaaaacctttaagctacatccaaaatattagtaatcaactatcattcaaccaataaattatgtatttatattagcagtaggagggtacagaggtttctaatacatataagtacataggtcatactctagtaaggtgaagaatagggaaaaatggtgttggaaaactatgtccaatgaagggatacacaaaagatgaaactcttaatgaagcatctggagaaaaataatttataataaaaatgcatagtaagaactaaaaaatttacagtgtatggcaagctctaccatcaaaacatttttgttttccttctccattgatatatgatccattctccagccttctctgccattgggtaagcccctggacataaaatttggcatattacaacttcttacttccctgtggaatgatgtagataacttgtggaaacctaaaatggcaaaagacatgaagtcagttgctgccttgtctctttaccttcacatttgtccctctttacattctgacaagaagaaataaactattttgctagctgactggggtattgtgctgtatcttgaccttttccccagtgaacattaaaatcacaaaattacatctgtgtgggaagcagatgaagtcttgagtgaatatctattgttgtcatgggcacagtcatgtcaaggagcccattgcctcagaaccatgggagtagcaaagccttccccgggtgagactcacggaaatgctaatgcctttttttgtccaagtatgattgtttatagaggatggaccagtgtgtgcaggcctattggtcacagattcctcctccatgactatagtctgagagtgctcacatacagagacctcctagagagattagataaacctgcctccctattcattagatgtttaaaaattaatatgctgaggttctcgacttgtggcctccatcacagtgagcacacaccaactgatgccagcctttatatacatatgcatgtgtgtatccttttcttgttgcaccagttaggtcagcccttgaaaacttctttaacccttatactaaaatcagaatgtggttccaggaatgtgaactcccattgagttctcagtctaatagggagggagtatatataggcttccatgctagctaccaagctgggaagagatgtggaccaaagcctgagatggggacagggcttgattgcttaatgtgctgtgggaaactatgttttaaagctaatagagataagagctaagttctggtagggatcagaaagcaaattaaagcttgggggtcagagttaacttccttttgttatccctcattaaaaacacccagtatgactttagtttatctttacaaacatctttctgtatactgtagttaagatgaaagaggtagtgttagacccccgaaaactcaagtatccggggtctcaggccaggttcgcggtcaccccaatcaccaggcggattcgagagcttgctgcaaactacacgaggctttaatgtaatttaacgagctaaccccatgttagctcgggtctttcacccacccaccatggcggacagctagaaagacggctcctacgggctcccaaaagatcttatagggcagcgtaaggggagtgtctaggggtacgcacaggcttacacaggctcatgattggtgtgcttccaggcttagagggcttgccctgtgttgattggtcaactggttgttatggctcataggccctcccagggtggttgctatgctctctacgtcattgtcgtgtgcttgtccgtaaagcacacccagggtcgtaaagcatagcgccaccagctaacttctgattggttccttgtcacaagacaggcatctgacytctamktgaccaaggcaggtwtatggcaagcacrtgttcggctrttatggctkccaaaagggaagccggttccttcagtaggatatgtgaaagaaccaattggatgctcatgtgctcatttagagatggtaccccattgtttcccatattagcaccaatgttcctcctgggcagcatgtttctgtcatcaagaaatgaatctgtttcccttccccctgagtctggatatgcaaaaccacctatagacccactcaagggttttaatcaaggtctgaagccaccttttttgttactgttctgctatatgtgaggcatgaagaaccaacccaaaaaattaaagaagtggggattttctaagtcaccccagccagagccaacaccagcataattgctaaccatgagtgaggccatgtgcatctgtttgacacttagaaaggacaggatgtgtctgagtaagttcactgtaacttctcctcttactattttctctgatgctgtttcaagctctgaaatttgtgagcatgtttgttgctaatgatggtagttggttcattagttagttacttacataaatgtggttttgagataaatttggatacttgacacaggatctgtctcaagaatccaaagcttatctaaaactgacattatgaccaaggatggtcttgagtttctaatcttcttgtctttgtattttgagtgccagaactacaggtatataccaccttgtctttttagtactggagattgaacccagtctcaattctaggcaagtactctcacaactgagctccatcctcaccctgttttttttttattttagttcagcaagaattaattgttatacctttttgccattgcagcctagggatggagtaacagaggaatatggctatgcctcaggtaataatacatatttatggagttgtcaaagtctttcttagtgagagaattttaagaaatattatgagaaggtaaggtgacaaacagaaaatcaaatggtaggaccatctgtatatttcaattttgcatatacacaatagagaactagtaaattaatttttcaaaggaagaaaaaaagaaaacccttcactatattaaagctttatctcaagtatataattccgtgtctttctctctaatagatcccatttaataaccaagggggcagattctcaagccttagtggagtgggaattattttttttcttttacttggacatgtgtaacattagaagatgaagttgccttacctgctgggttgcatcaatgacattgcaggtcaagcttatctctaatgaatatttcatagccatccactggtgactatatcttcagtgctcctggacttatctggctcgaaatctgcttgggaaggcacagcagctactacaaatgggcagtgttgagtttccctcatttggagtgcctgatatggtgtgcctgatatggcgtggagggcagttagacagaggtttttatataaaacgtctgaagccctaagatttgttaggttctgatttcaagattctgcactttggttgtagtgtgtctgtagaacatgcagttatgtgtccatttcaaattttcttttttgattacattttcttacttattttgagcatgtgtagtgtgtgtgtgtgtgtgtgtgtgtgtgtgtgtgtgtgwgagagagagagagagagagagagagagagagagagagagagagagagagagagaagtcaaaggacaaatacgtgagtttcaccatgcacatcttaggtattatgctcaggtttattgggcttgttggcaggcacatttacccactgagtcatctcactgatgttgtttgtaatgttttcatagccatgatgtcattgtatagaaatctacttggagtgtttgttacattttggcattaccagcattggagttccataaaaaagataatcttcaactcaaagtgtgaaagtacagaagcttacagagtttggggaactaaagaggacataactaaattctcacatttaaaaatagtgagcatggagactggagagatggcttgtgattaagagtatgtgctgttcttgcaaaagattatagagtttggttccaataatccatgttaagcagctcacaaccatgtttactccatctctatagaatctgatgttctcttctggcttctacctacctgcacacacatagacacataatcaaaaataatacaagttctttaaaatataatgaacacagagaccctcagaaagcaagttgtgagggacagtgtgtacagaaagcttggatatgaggttattttcaaggcttgcgaataaataaaagtgctgtttctactgttcttttgtttgcttttatgtaaaatgcaattgctgtcatgtccctgccaccagtgttaagtgtcagtccagaagatcaggaataactttctttttcactgtggctcccaaagtttctagagaagtatagtcaattctgtcctgtactaagaagactaataaaaggtcaagaagggtgtggggtgagagggaactcattaaagtagacatctgcccattatttattaacactaattagaccaatgccctgcaattatattcttctaaattctactccagaagaggggaatggggttctaaataagtgtttatttgaacagaaaattattctacttagactaaagaagatcaatacacttccacttacctgaagtttctaagtgtggtatcttcaaataactgaccatcctatagttgtttttacctattaactgactttgtggaaccaaccatgccctctaccaggttacttaagggctggtgcaagacttctgtttggattgatgcatatatttctgaatttatggattagctgagttcttaaaaaatcctcctaatcttataaattcttgggaattttaaataatgaataatgagtatccaagttagaaaagtaaatagaagatgtatagttggaaattcttctctatctcgtctggtcccactgggtaggtttctctcccacccatcaggtccccacagtcacttatggaataacattctggggcttaatatcaattataattgtttggccaatgacttagacatattactggctagcactctcttataaatgaacccatttctattaatctgtgtattgccatgaggctgtagcttactggtaatattctggcatgttactcctttggtagctatacagcatctcctcaactcctccctctttctctccataactttgcttggatttcccacctagctttactttgtctggtcattggtcaaaacagctttattcatcaaccaataaaagcaacacatatttgcagcatacagaatgatatcccatatcagagatgtactatttttcttggcaaaatggtatggacaacaccaaaactatttccacggcaatgggtacaaaacagctttgtagtgattaagggctttcagagttacattgttctaaaagctacctggaaattctaagtgaagtgaagtgaagtgcataataatcagggataaatcatcatataagacaaataaaatcacgtaggcaactaagagtcagtaaagccattaacaactcagttggaagagaaacattatccaatatatcttttcactcaggaatttaaatctacacaacatagcataattacccaatcccagctaaatatctcactgtttcttctttgccagtcatatttcaaaggcactgagatggtggcatcccatttttgtagtagtatcatatactttttaattgagagcagatggctggattatactctatagataatatatttcctgattatgcatcctaggagattaaaaaaaaagcttaatctccaacccttttccttacttgaggcaaaggcacatggggtttgttaaggagattagtcacatcggtgcaattttaattctccccccaccccgaggattgtattttctgttgttagctctatataaataatgaaaattctccttggggttaactcagaggttgatctctgcaggttggcctgactcgctatgtgaaacctctagctagggttgagcatgccttcgaaccaaatctctttttcacagtgacatgtgccactcagataagacatagacagggttgtgtttttgtgaatgtgtatgtgtgtatgtatgtgtgtgctcataaccgggctatctcagtactaacaaaactacttctgtgaagagatggcaataatgaaatgtttgtaggactggaaggaaaaatgtttttattgtgtagatgcttatataccacaaccactcccaaaggtaaaaatcatttttatcttcaaatgtaataacacacaaagcacatgcaaaccagatgagaaggaagtgtagaattgtgagttagtggagggcacattggaatctgaaaacagctgagctctgtgtgccatacctgggaactgatgtcctgtgagaatataacccagtaacttctctatagaagatgagcctatgagtaccagactcttaacctatgctaggcaccatgtgtgtttggtgaggggtgtgcttttatttattttctctatatttattttctctttataaatgacttatacttgactcactgcggggagagtaggagaattggcacagtggttaaaaacgcatatttgtctcatagagaacttaagctggggttccagaattcaggtcagacatcttacaattgcctgtaactttagttctactgaatacaatgccatttttgcctctacaagcacctgcatacacacacacacacacacacaaatacacaaatacacaataaaattaaacctttccttaaaaaatgaacaaacaagggcacagagaaacagtgacttgccatggccacatgctaataataactaacacaaggattccttttgaaaggggaagacccaccaagtcgtaacgttgatctttgtacagtatagtggttgcctcaacccttagctaggaagattgcttgttggcccagtcaaaaatgcaggtatataactcatgttcccaaactacagtaaaaggaaagaaccagaactattatgtgagtcctgagatgctaacctgatgtctcccactaaagtgaatttaaggagtatgccttcctttctaactcaccgcactactctagttgaagtgatgtcctaatagacaactctgcaaagtggaaatgtcctggtggccaaaccctcagaattacaggctcattccatttgtgtgcatgcttttccagaaacaagattaaaagtcagcaatttctttaaacctcaagtgagccaagaagcctgtggttactgctctgtatgaaccagaacaacgtgtgccatccttcccactgtggcttttcaaaaatcaatttgcattgtatttcatccctaaatgcttttgttgagagtattctagtatttctaatgtaatctctcagtataactataacattcctaaatattcagatgttatgtcagtctagaattcccgaggaaaacattttacttggtaacgaatatgtgtgtgtttactatataggcacagatatatctaataccttgaatttacatgaattatataattattgcacttcatccttgtatagtcactttgccactcaaataagacatagataaagttgtattttgataggtgtatgtgtatatgtgaaattacaactgagctatctcagtactagcaaattacacttctgtaaggatatataaataatgtaatgtttacagtagtgtagggatagatgagattacaatatgctacaaccacttataaagatataaagcattcttagcttaaggtactataaaaacaagtggtaattgggatttgccccactggccacatagttggatgtttaattccagcacaggctgctatgttgagataggaatttataatagcctgcatttcactttgtgcatatgtgggtgtgaaatatgtctgaaattatagtttcatttgtttgaattatcatttgaatggcttttccagagtaaggaaatgatcttgcacttgtgttggttctttgggaagaaaattctcaaatgactttgatgatgtgtgggataaatgggagtctctggtggtgtgtaagactgataactaattggggttttgcaagggcccatttcccttggcagtttctaccaggaagagatagtgaaggctggactgagctaacataccaccagcataagtaaacattgagaggggcagatggccaagaccaatcaggagtctaccaacagcttatgagagatatgatcttgttaaactcaatcattttgtcctcaattctttattaattacttcctgtgtgattcatttctacatggtgtcactccttttatatcctataaaccacggtgttattctacacactgaaatttagatagtcatttttgtggcaggaagttctaatacattggatttgtctgaagcctccaagtacatctgcaattatcttgggtgtgctgtctaaagagaactatgaccaaatgatagtcatgcagtgatgcttagttaaactatgtgtataatttacttggtgatcacttatgactcccagacctctggtcttctggggtatatctaaaacccaatgagatctaactgtgtgagaaacagaagtacctctaggattctgtaggaaaccaaggttcctttcccctagacaattgcatatgaagaatccaaggcccactcaaacccaccgcagacaacaccatgtgaataacacatgctcagttcttgttccctaaatgacccaaaaaaggtgaagacagtattagagcagtccttcctctggattcaactctgaagaaattgctatgagttatattaaatccttgggattgctaactgaaaaggtgccctttttaacttcaagattttaacaaacatatcaatacatgaccccatctaagtcaagttttcacttgtaaatacatctagagaaagtcatgggacaccctgttttcaggaaactcaaaggaaaattttttaatagattagcttcattctcatttatttttcaagaacaaaattgtaaaaacatttaaaattttaattacattcttatttatgtgtgtgcaagcatgcatgcatatggcaaggcacatgtgtggaggtcagaggataacttagaggtatcacttttctccttctctgttgtggcacctggggacttaggcttagtggctgagccatcttgactactataaagacaaaaaagatgaagctatcctagttatcttactttgtttcacaatggctacatggtgatgatggtgaatggcttctaaaatgcaacccaattttactttctgttatttgagagagcaaaaaataaaatacctggtaaacactttttgcgatggtaatagcaaaattagaattaaacagggaaaaatgttatctgcagaaacaaattgaagaaaattgaactgattatacttttaaagagaatcatatgttggtgctggacaggtggcccagtcattaagagttcttgctgctcttgcaggaaatcccatatcagttcctaccacccatatcagttcctaccacccatgatgaaggggctcacaattgctccagtggcccattgccctcttctggcttctgggggtactgcacacaggtggcatacactcatacttaatttgggttttttaaaaatcattcaaaacataatttaaagtctacataaaaaatcacaaaatactctctttattgttgattctatattattttaatgagagtctaaaaataaccataactctactgccaaatttcctttttccacctcttctgtttagtttaaatgtaaaatctgctttcacatttgtccatggatttatagtgcttgaaataaaatgacaaattattttgtggtttagtggtttaattgcctgccaaatttctaaactttcttagcatgtgtgttctgcattccctttgcctcattttctatgtaaaatggaaatgaataagtgctttttggaagagcttagataatttcaaggtctgcttcctgccttccttaaagtgtacgttcaagtccaagatatttgttttcttttcactttgcaggaaaaaaaaatgcctcgcttctcccacaaattcagtataggcatactggctgccttccttcttgggcaggctgcctaagtatttaattgtccaatcactacatgagaatcattttgcccaacagtaaaatgaggctgcctccatggtagcagggagcagctgtcaaaggcataagctctgctaccctgcaggctggggtctggcacagaaaagattgcatctccatttccaagatgggaagaatggtggtccatagccaacggcacattactgttttaggaacttggctttgcctccactggcctcctctgtcatcctcatcacctttttcctttctgtggcatgctctcaccactgatcttcacagggttaggcttgtttttgttgttttgttttgttttgtttcgttcttgtgctagtatctctttcacttccatagttaattccccaattgcttgctattgtgctcagtaattatcagtttcaagtcagctgtgatttataatgtcaccttgaatattcagaattgatttcaactcccctctgagcacactctgatggggatttgggaagatgctgagggagagaggagtaaactagggagttgggtgactgccagtgatgagaaaccctgtgccaaggagtggccagggacggaatcacagtctcacagagctttctagttaattagatttggtcacatgacctttgcaactctgccaattgcaagaaataattgggcatacattgccaggctgccagggttctgctgccatgtctggttaagacgtgaggtctctactagggtcatattcacagagcacatcatgaaatccctcacactttcctagtgaagtttattttatctgcactttgttggccttcctttacaccttatacttgtcaatgaatcaagcactttgtatgacttttctgctcttaagtcctttgggaggatggtgtgaagatcagcttaccgtgttctttctcaagtctcaacgtgtcttcatttcttgcatttgatcaccgctgcctcactggtatcgcacacttcagactctctactgccatccctctgtttttaccatggcttctattgctctgcaactgaaagccatcactaacagagaatgctcagattcccctacaagtgagaaaaaccaaaggacttttgaaaactggaggagttccatgatgatctgaaaaggatgcctcacctgttctcttaccttgtctgtgttcttcctttgtagcttgtgaacagacagggtgagcactgaaatgcctttgtaatacaatcctgtgtcctgtgctcaagacaagaagagcacactctctcctggcaatccttctaagagttaacatcttaatgtttccagaactcagggtcccctttaaatggttcagtcttgcaaataaaataacttagaaaaaactttgaaggcaacttgagagcaatttttttggaatatgacaagaaaaaataagatgggcaatctttacagaaggagatggaaggaagctggagaagggtaggtggtagttacaattgttgagttaaaaggaagtcaggtggagtcagcaacggaagtcagcaagcagcaactttgaggagggaannnnnnnnnnnnnnnnnnnnnnnnnnnnnnnnnnnnnnnnnnnnnnnnnnnnnnnnnnnnnnnnnnnnnnnnnnnnnnnnnnnnnnagggagggaggattctcagaaaactggcacagggatgtctcttcagagaatatgaaaatgcacacacagaggttgggacaaataaacttaagatttggattggtgcctagaaagtaggaatagaaaaaggaagaatataaaggttaaactttctgtgttatacctcaggaaaaaaaaaggattgttagcagtgttaattatctgtgttgaggaataggcttctggggaacataaatgggtgtctcattaagtggatacttactgcttgtatcttcttaagatatctctaggtactaaaagcaggtgccactaaataatcttaaattatatctggaacatttcatttaatatttattaggtagcagtttgtgcatttgacaataacttattataaaaagcagcttgtatattacatgctcctgcaggccatatacgtttctcattcattgatcttggttagtgacctgtgaatctgagtgcttctaggttaaagttgatgtgtcacttgtctccaaatcagggtgcagcactgaccatggggaatctgagaagctaagaccttaagttctgttcttatgtcaaatctttctgtaccactgctacacttgtgactcttagatttatgtgattggtttatgtttctcaccaggctcaccaattcagtggcacctcatggatctctgaaactcaacatatttaaatttctgacttcacacctactttgcaataggctgcacatttccagtttcccaggtccttgttcccatatgtgtctcttctctctggtaacttacttccttgttactgtcctcaaacaccatggctgaaagcaatataagaaaatctatctgtcttgtgatttcaaaagtctagctgtccataatggcagagacagagtgggggcagaagcaagaagctgagagtttgcctctcgacctcacacaaactgaaagtgtggcaaggcaataaattctcaaagccaacctccagcactctattaccttctgcaatgaacacatcctgaatgttcagtagccaccaggcagcagcatcaatgaaagatgaggtgcttaatagctagagcacatgggggacaattatttttatttcacatcaccatactatgatatctgctgccttctaatattggctctactttcaaagtatacacaaggcttaaaatacagaatgtcattctgtttctgcatgtgtttactgtttgtttactattatatcaatgagaagcaacctatgtattatctcttcatttgcttagttttttgtttttgttttttttttgtgtgtgtgtgtgtgtgtgtgtggttttattttggtttgtttgtttcagacagggtttcttgtcgtctaggatgacctccaagctattgtcaaagatagccctgaacatctgatcatcttgcttctacgtcaaacaagtgccatcatgcccagccaaaactgagtaatcttttgctctggtccagccttggctctctgacctgttttcttccctacactaagaaaagtacaacctgaataatcttttcaatgttcagtctcacttttgtcacttctatttggaaacctctcttagtttgttctgcagagcacagtcgtcttttcctttctgaacaacagaaacagtcttctcaagcttttccttaccactctgtcaactcactgtatagaaatgttttggtaattcacagggataattttatttgtttagtagcttagtgttataaaagtcagaaacaatgttgcttatgtttagaaagtgtgacaagacaatgagttaaataaaattcataaaacatgagaactataaaaattaagggaacttttctttaggtttgacctcatgtgctagccttcagtagaccagaccaaacaaaacacagtcattaattactaaagtgacataatagaacagaaactttcaggaaatagagaggcacataaacagattcccttgtcccccaaacattagatagtgttcctgattccgtatagtatagcattctccttggttccttccaggaaagcaaacagaagaaataatctaatgcaatcctatctacttcctcccattgttttgttttctggtttctactttgcaaaacccacaactgctgctttgagaaagccctcattctatcacataaaatgaagactacccaaattattaattacaatgaaatcctacttgatctatgaatgcatttgtgtatttatgtcttttgacagaacaaatgaaaatgcattgcaaaataaatatgcttgagaataaagtgaacgcaatggaagaccatgattgttttgcagctgggattattgaaaggatgatttacagaggtcatagtccagcttttggacaccgtctcatacaaagtagtcaaaataagatttctgttatcgtgaagaatattctgtcaacaatcatgatggtggtatgggagatagcatcatggcatgtgaaaaagattagctctgatagtttgtttagtctgtaaaagaaagattgacatttctcagtaagaaaagaacaggctgagaagcagcttagaagctcaaatccatgtggatgcataggttagatactgagaaactgaatgtgtcatgagataacacaaaggggggcagtttggagaacatttttctctttgtaatacagattaattaatgaatgtaagacagtgatcattatcattatatctaacaattattatttactatggattggaaccgattgaaaatatgcacttctcctttcatttcaccatcatcagttttatggcataaattcccatagaagatctcagggctacagttcaaagccaggcttaattcaagggcatgttactagcctgtggatatgaaatactttgctgaaacaattcatataacattcagacttacaccactcatttcacaaagtagccggagcctgtgaccagcagagtacagtttgcagtgaggccatatgcagtagagagacctcagggtgtgacataccaggttggaatgcctggtgctgacttgtggtctcacttcaccttccacactggccagtcctgatttccttaccgtgagttgtcatgcctttcacttttacttataattaagtttgtaaaatctaaaaagatgctggagtgtaagataaaaattattgtcacttggttttgaaatattaggagaatacttttcctggaactctttggattcttaatctgtcaaataaaattggtgatattcttgacactgttgattctaaatagtcaacaagatggcatatttacaaaatccaaagatccttattaatgataaagtatgtaaaatatagttatttgtcatatttatgtgtcccagtgccttataattgtactagaacaaagttcacaaagtgtatattatatgagatctaatttatataatgtatgttgatgggggaagtacttctgtgtatgtttatcttatagattgttgaataaagttctttttggccaatgaggcagcaagttagacaggactaggagtcaaagtggattctgggaaatgtagtagagaagtggtgatctagtcaggaagtgacataacaaggagaaacatattcaagcaaggagaaacaggaagtgtccctttccccctccgctcttcctccagtggcacaatgtaatccaccggcaaggaaggacaccaatggaaggtgttctataagataaatcttataaaatatatagatttatgataattaagactgagctaacagatgagaatcctagtcattggccaagcagcatttgaacctaatataagtttctgtgtattaatttgggccctaacttgggcgggttgctgacgtaaagcacacacgtggtggtggtgcttggaggcctttggcagaaagatttattctaacagtatatttataatatttgtctgcttctgatatatatattatttgacttaacaagtatcagtgaaatatcttcagtatgttaagctggataactattttgtaaggcatagagatactggggatctcctgtgtttactgtgatactgatgagacaataaggccacacttgtgtgaagaactgcaaaacatctggcatggcactgccatcaaagagacttgataacttgctatagttgcagagatactggtatactgttaggtgataggaaggtccctgataaaggcctttatcattcatgggacagccagtatcaggaacttcatattccaactgaaatatgggctgtttgtatgatttgatgtagaataagtgatgctcagaatacatgaaaacatggttttaaatctcagtgccacataaataagtcagctgatcaagtaatgaaaattatcaaacactgaaaacactttacaaatagatgtttagaaatttgcttttctccctgatattctaaatgagcttgtaaaattagaggagaataaatttaatgaatattaaaatgttaaatcagttgcatttaataataacaaaatgttttgttttccaaattgaattaaagctgtaaaattggcttatgaaaagaaattaatagcaatcatgatttgaaaagcttgatgtcgccaaaatacaacacttacataatagcatacataactggggtgaacatatgaacatatacataaatttgtgactcttattaactgtttacattatcttcacctgcctttcatacaaattattttaacaccatggtattttgtgacagattgagaaccatagtttaaaacaagaaaaaaaaatagttatagttttctattaaaatgtattttttttggaaaatatattgcttttttgtagtctttggggaaagcacattaattgacttctttccagtgaaataaatccttctccttaagtctctgagtcatcaggagaaacacctctttctaccaacatgaaagcacccttaatacttgaaaagtcatcttttgttttgaaaataagggacctagcagagcttaacccagagtaaaaaatgcttacttttctccgtgtgcataaaatacctggtaaaagcaacttgagggaggaagaggttattacagctcaaggtttgagtgtaccatccataacagtgggaaagcatgaccacaggacagtcaggtagctgatcacgttgcatctgtattcagataggagagaaatgagtgctcgtgttcagcttgctttcttccttttcactcatcaggaccccaggcctcagaatggtgcctcctacacttagagtgaaccttccactttcaattggtcaaatctaaaatccctctcaaagacatctaggtgatctagattcttttaagttaacagtcagtattagccatcacagagtgcatattttagttcaggcttcattgtggtaccactggaacacaatcctaaatgcatggtgctatttcatgtttatatttgtctgtgaggtgcttgaagctgtctataaaggtccactctcaatactttatgagtagaagcggaccatgcaaagcaggaagacacttgggaatgcaaactttgtccaagataaaaaaaaaaaaagcatttgatgataccattcatttgagaagaatttacaatagatctaaattagtcccaggttggtgaagaatttcttaataaattaatgcttccttttcattacaaaaccacccagcaaagagaaacaaaactagggaagaaacttggggagagtgcaggaccacaagtggggcaaatacagagaatgagaagaatcaatcaagtcagggaccaagcccacaggggaggtgtatgtagtttgtagcatgggtggtggctgtagatagtagacttctcaacgaatgcatttccaagcccagaaatagtgttaagcaaagaagaaaaatcttaaaaaatagctaaagtgtgacccagagtgtgctattaggaatacaaatccagaatgaaatctctgtatgctagtagcacatagtcaaactaacctaaactaaccattctactggtgataaattatttatgatttattatgcttgcctgaaggtacagaaagcaaaactagcacactagttagctatgtagccaggcagaggtggcacataactttaatcccaggactcaagagataacggcagatggagtccaagaccacccttgcctataggacactgaatcagagctcacacctttaatcccaggatttgagaggtaaaaggtagaaacattcaacctgagtgttaatctctagtcatgctgaggagagcatagcactctgagtgaatctggggagcagtgaaattgggagcagtctgaggattgcctctttggtctgagtataggtagaggtaagagctagtggccagctgctttacctctctgatatttagcttgaagctcaaaccctaatatctgtctctgggtcttttacttctcatgttacacattcttgcctagcttggagttcagaattagctctctaaaatgtacactatggggagggtgaaacatatatgattcatgaaggttagtctagttgtacatgagaaactttttaattaattaattaaattttctcagattggtcacagtttccccttccttctcttctccttccagtagctccccacaacctcctctgccatgaccactcctcctttctcttcagaaaagcataggactcccatgaatatcaaccagtcatggtatatcaagtttcagtaagactagacacctcttctcctattaggttggacaaggcaacacagtaggaggaagggtccccaatgcaggtaacagagtcagagacagcctctgataccactgttcagagccccacaagcagatcaagctacataattataatgtatgtgcataggtcagtcccatgcatgttctctggttggcaattcagcctctgaacccatatgagcccaagttagttgattctgtgggttttcttgtggtgtccttgtcacctctgtttcccataattcttccctagctcttaggaaaacataaatcaaaatgactctgagattgcatcttacacctagcagagtggctaagataaaacacacaagtaacagctcatggtggagagaatgtggagcaaggggaaaactccttcattgctgatgggagtgcaaatttgtgcagccactttagaatcaatatggaagttgctcagaaaacttgcaattgacctacctcaagacccaactaaatcactcctcggcatacacctaaagtatgtgccaccataccacaaggacatttgctcaaccatgttcacaaagtaatatccagaaagtggaaacaaacctagatgtccctcaactaaaaattgatgaagaaaatgtgatacattgcacaattgagtattactcagctgttaaaaacagtgacatcatcaaattcatcagcaattggatggaactagaaaagatcattctgagtgaggtaacccagattgagaaagacaagcatgatatgtactcacgtatacgtgcctattagctataaagtaaagggtaatcatattataatccacagacccaaagaaactatgtaacaaggaaagcttaagcaggaacacacaaatctcactgtgaaggagaaatagaataggcatcacaggtagttgccaagggatctgggtgggggtggggtgggcatgggaacaggagggatcaggttggggaaggatggaaggagagagtactgggaaagacaaatggaatcggggcacctctggaatgagctagaaacatagtgcaatggaaactcccaggaatctatgaaggtagtccctagctaagactcctggtaatagaagaaactaagcctaaacctgccatctcctgtaaccaagcaagatttccagtggagggagttgagacaccaacacaaccacataacctttgacctataatttgccctgcctacaaggtatgctgaggtaaaggtggtgcagaaattatgggagtggccaaccaatttctggtccagcttgaaactcatactgtaagagggagcccagcttaccactgacactgcttggagggccaggacagagcctgtacagctcagaggcctagggtagaatcaaacatgattggcaaagaaaaaaaaagaagtcaatgaaatgattcttaatgatactctgctatcctcataggttgttgcccagcccacttctcatcagagaggtgtcacccagcaactagtggaaatagatggagagattcacagccaaacattaggcagacctgggagaattctgtggaagagggagaggaaggattatggaaagggatagctttcagtgggatttgcaagcctcccaaagcagaatcccctttctctcttatgtttatctcccttgttaaaatttccattaaggacactagataatgtttttaagtaaaaatgttctaaacaaagcatatcaaaagtggaaagcattgtcagtaacagttatcaatactggaatgctgagaggtgggcttttcatcattggttccctccccctacacacacaattttagagaatgtgcggaagagtctgtgtggaaatcccagtggagggtgggggagatacagtggaatgtgttgttcacatcagcagaagcctggtgcagtgatcctctaaagacaataacattcatcttatttcttttgtttaaatggaaaacctaaatgttagtaaagagtagctcatcttgccagaaaaaaaatacttctggttttctgtatataaatttctggatttacagaaagaaatcagggtaagttgatgttcatagctgatgtggaggctagctggcctgtgagcctgtgttctgtctctgcttctcttcctacatctgtcaccctgtctgacttttatgggttcttaagaacagtaatcaagtcacaagattttgttttgagacagggtttctctgtggctttggagccagtcctggaactagctcttatagaccaggctggtttcaaactcacagagatccgcctgcttttgcttcctgagtactgggattaaaggtgagccccaccaccgcccagctgtcacaagattttttttgggggggggggtaaacatttgcctaatgagtcatcttccaaatcccccaaatttagaatttttaaagtaaaatgcagtataggaactgatacaccatgtgaaacacattcctatgacacctaacttttacaataggacaaattgtttttaatagccaatagaaggaagatagaggtaccaagggacacagagaaatgaggggctaaactgaggccccaaagacagcttggaagaccccagtgtcacataactgactgagcaacagatgaacactggaatctctggcatgaactacatggtgagcaataaagactttttgaagtaaatttagatttagctcagtagtagagtgctttttcagcttctgtgagactctgggttccatttcacttctgtcatgaataaacaaaccagcaaagaataaataattaagtttcatgcacgggcagtcatttaacttgttttaactcccagaaaatctgggatacaacaatgactactgcaggacaagtagttagaggttggtaaatttcattgtattctacattctcaatcttttcttattcccattgtttccatcctggacacatgagattacaacatcagaagaaatgagagctttcctagacagctcctgggtctggttctggcaaactacagtgtagggtaagctgtagccatgcctacttaggggctgactacaggtgtgcctgaccacactttcgagggcgtgatcagggtgacatagagcgagacttgaaggggacttcgtctctcttttggtttcacttttcggtttcacttttaggctggctaggttgctctgtaagtaattaaatacccttatatttccacttggctccgtattgataatttcccactatactacagccaatggtctgtgtgtctgttctcagatgtccatattaaaagtattttgtagcctattgtaaaattccacatatgcttctccttttctggtttgcttgtatacattaaaatactgtttacacagagagacacatacaaccacacattcaaacataaacatactatatcacacacagatgtcatctcatatcagacttgactttaaacccaggaccaagccccttcctggaatactgaccctctgagtgtggggcccaccactgaaaattggaaaagaaactttttctttcacttgggggatgggggattctcctgaagttacccttgttttgaaaggcatatagtaagctccattaagcattgaattgaagaattacatggtatataggctatcctaaagactacagaaatgttaataccccatcattacacagaatataacaaagacttggaggtatgaggctgatagatctttggaacaaataacaaaatgcaaggaaagggaaagtaaaatcactattaacatggcttttacaatttttttcttaaaatttttaacatcactgcaccaaaaggagcctcaaattcacagtgttaatgtcacattagcatatcttttcattctataaactatatgtaagttctttttccacagggttatggtagtaattattatgaaaatgtattttattccatatgtcatgaaggaagcagcatctcagacagatataggtcagtaaccatggtaatagtgcactctatagaacagcataataatgccatgctttccttggaagggacaagttcagggatgtggaactgagtgggtactaaaggagaaattatcgggtgatctggatggacagcatcctatatgtgttttcagacagcacatgaggttctttccaagaaagtttcatgtgcacaggcaaagtaaagtttgggttatatgatcagtccagattttgctgaatgccatttatttcatcaaataaagagctaaagaggaaattcttgaagatgtgagctgtggtaactgtcatccaaatgtggaaatatatatatatattatgcctcttgccatatatatatggcaagaggcataagtattatgagagaaacaaaggctacaaggtctcttgagctggcagtgtgcctgacttgtgctcatgtgaaggatggcatgaccctttctcttgcagagtgtcttatccactattgtagtgctgtgaagagacaccatggccaaggcgactctcatgaaagaaagcatttaattagggcttgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactttcaatcactatagatggagaaaacaagatattccacgacaaaaacagatttaaacaatacatatctacaaatccagcaatacagaaggctctggaaggaaaactccaacccaacgaacataactacactcacaaaaacactggaaatggataatctaattttaccaaacacaaaaagaaacagragggcaaaatccacacgcaatggtaccaccaacaataaatccaaaacaaagaagaaccaatgaacagtggacattaatatccctaaatgtcaatggtcttaacttacccataaaaagatataggctaacagaatggatacgaagacagaatccatccttccgcagtttacaagaaacacacctcaacttcaaacacaggcaatatctcaaagtaaaaggatgggaaaaattttccaatcaaatgggctcaagaaacaagctggggtagcaatcctaatatctaacaaattagactttaaactgaaagcaatcaaaagagatgaagaagggcatttcatactcatcacagaaaaagtccatcaagatgaagtctcaatcctgaacatatatgcccctaatacgaaagcacccacatttgtaaaagaaacattgctaaagctcaaaccacacataaaaccacacacacttatagtaggagacttcaacaccccccttacaccattggacagaaccactagacagaaacttaacaaagaaacaaaggatctgaccgaagttatgacacaactgggtttaacagatatctatagaacattccatccaaacacaaaagaatatatcttcttctcatggccacatggaaccttctcaaaaattgaccacataattggcagcaaagcaaacctccacagttacaaaagtgttgaaataaccccctgtatcttatcagaccaccatgtattaaagctagaattcaacagcaatacgaattgcagaaaacctatattttcgtggaaaatggataacacccaattgcaccattcctgggttgtggaagaaataaaaaagaaattaaagacttcctagaatttaatgagaatgtagacacaacataccagaacttatgggacaccctgaaagcagtgctaagagggaagttcatagmactaagtgctcacatgaagaaactggaggaaagtcacattagagaattgacagaacaactgaaagctttagagcaaaaagaagcaaacacaccaaggaggagtagacgccaggaaataatcagcctgagagcggaaatcaacaaagtagaaactaggaaaacagtataaagaattaatgaaataaagagttggttctttgagaagatcaataagatagacaaacctctagccaacctaaccaaaaggcagagagagagcatgctaattaacaaaatcagaaacgaaaggggggatataacaacggacactgaggaaatccagagaatctttaggtcatactttgaaaacctttattccacaaaattggagaatctaaaggaaatggacagctttctggataaatatcacttaccaaaattaaatcaagatcagataaatcaagatcagtttaaatcgacctataacccctaatgagatagaagcagtaatcaaaagcctcccaaccaaaaaaagcccagggccagatggcttcactgcagaattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaatccatcaatgtaatccatcatataaacaaactgaaaaagaaaaaccacatgatcatctcactagatgctgaaaaagcctttgacaaaatccaacatcccttcatgataaagatcttcgagagaacaggaacaacaggaacatatctaaacatgataaactcgatatacaccaaaccaatagccaatatcaaagtaaatggagagaaactcaaagtgtttcctctaaagtcaggaacaagacaaggctgtccactctctccatatctcttcaatattgtacttgaagttctggctagagcaataagacaagaaaaggggatcaaagggatacaaattggaaaggatgaagtcaaactttcactatttgcagacgacatgatagtctacattagtgacccgaaaaactctaccagggaactcctatggctgataaacaccttcagcaaggtagcaggatacaaagtcaactcaaaaaaaaattaactcaaaaaaatctgtagccctactgtatacagatgataaactcaatgagaaagaattcagggaaacatcacctttcacaatatccacaagcaacataaaatatcttggggtaacactaaccaaaaaagtgaaagatctgtacaataagaactttgagagtttaaagaaagagattagagaagataccagaaaatggaaagatctcccatgctcttggataggtaaaattaacattgtaaaaatggcaatcctgccaaaagcaacctacagattcaatgcaatccccatcaaaatcccaacacagtttttcacagacattgaaagaacaatactcaactttatatggaaaaataaaaagcccaggatagccaaaayaactctttacaataaaggatcttctggaggcatcaccatccccgacttcaagctctactatagagccatagttctgaaaacagcttggtattggcacaaaaatagactgatagaccaatggaatagaattgaaaaccctgatattgacccacgcacctccgaataccttatttttgacaaaggtgctaaatctatacaatggaaaaaagatagcatcttcaacaaatggtgctggaacaattggattcggacatgcagaaaattgcagatagatccatacctgtcaccatgcacaaaacttaactgcaaatggatcaaagatctcaccataaattcagccacactgaatcttctagaagagaaagtaggaattacccttgaacaaattggcacaggagaccgcttcctgaacattacaccagtagcacagacattgaggtctgcaattaataaatgggacctcctgaaactgagaagcttctgcaaggcaaaggaaacagtcagtaggacaaaacgaccacccacagaatag

SEQ ID NO: 5 - DNA, 68962 bp, Cricetulus griseus
  misc_feature (16317)..(16326): n is a, c, g, or t
  misc_feature (21699)..(21708): n is a, c, g, or t
  misc_feature (29578)..(29606): n is a, c, g, or t
aagtgaatacacatacatgcaggtaaagtgctcacgcataaaaatatatctttaacttaaaaaccagctggtgctggtggcacacacccacaatcccagtactagggaggaagagacagatcaagtattcaaggttattataaactacataaagagtttggggctggacctgaggtttgtaagactatctccgataaataaataaggggaaagaaatccaaaaacaaactataagctataaattgagtggttctttacaaagcaactattttgtctgggtttggttgatcatgcctttgatcctattatttaaggcagaagtaggctctctgaattcaaggccagccttgtagtcattatagctccaggacagtcaggactgtcaggcaacgattcctcaaaacagaacatactattttgctccttgaactggggccattttttttttctttttaaatcaaataatcacatcttcattaaggatgctttacttgctgattaagtggagataaaaaatttaaatgtttaagccaggcagtggtggtgcacacctttgtttcaagcacgtgggaggcagaggcaggtggatctgggtgagttcaaggccagctggtctatgaagtgagttccagaacagctggggttgttacacagagaaacaacctgtctccaaaaacaaacaaacaaacaaaatttaactgtttatactcagtgaattagtgagattgtttatttttttattttttatttttttggttttttgagacagggtttccctgtggctttggaggctgtcctggtactagctcttgtagaccaggctggcctcgaactcacagagatccacctgcctctgcctcccaagtgctgggattaaaggcgtgcaccaccaatgcccggggagattgtttatttttaaacattttgtgtatatagatgtttttcctgtaggcatgtctgtgcacctggtgcctgcaatgcccagggaagccagaagagggtgtcataccctttgggactgaagttacagatagctacagactgccacatgtgtgttggaaattgaatctgggtcctctggaagatcagccaacacttttaacttctgtgccatttttacagtccttaaataataatgatgatgatgatgttttttttttttgagacagggtttccctgtggctttgaagtctgtcctggaactagctctatagaccaagctggtcttcaactcacagaaatctgcctgcctctgccttccaagtgctgggatcaaaggcgtgcgccaacactacggggcctgaaattatttttaatgaaggagtcttttgttttttgtaatagggtctcattatatagtcctttttggtttgcaattcactgtgtagactaggcaggtgttgaactcatccatctgcctctgcaggacctaactcaaaaaagatattcattcattcgtttatttatttaatgtgtggctttgtgagtgtgagtaccaagtgccgtagagaccagaggcattggatgtaattggagttaagggagttgtaagtagcttggaactgaacttgggtcctatgcaggagcagtctgtggtcttcatctctgagctatctttccagccctgaattaatttttaaaattatgcagttaatgtttgtgtgcttatggggcacagggccatgatgcaaacatggaggttaaaaaacaaattgtggtagttggttttctccttctacttataggttctagggattgaacccaggtttttaggcttggcagcaagtgtctttttagccatattgctggcccctaatttttattttagttttgttccttttttttttttttttttttttttttttttgagacattgtttctctgtgtagtcctggctgtcccggaactcaatttggagactaggctggttttgaagttagctatccacctatctctgcttctcaagtgctgggattaaaggccagcgcaactaccaacactaattctctttaatttaaaattttattattgtgggccagtgctcacatgtggagaccagaggacatttttaggcaattggttctctccttccactcttattaaacttaggttgtcaggtgttctcagcaatcactcttacctactaagctatcttgtgtagctagcttttttgtcagactgtcttgactgctagccaaaaaataacaagacagacttcttaattatgaaagcttagatttgtccccaacgagctcatttgtttcctttgttttttgagacagaatttctctgtagttggagcctgtcctagaactcaaaataatatttttctcaaaatgcaaaaatttgggggccagcaaaatgactcagtaattaaagatacttgctactaaacctcacaaccgaagttaagtcaccaggacccatttaatgcaaggcgataactgactcctgcaagttttcctatgacaattccaacatggcacacataaaataaatgaatgttttatttttctgaagagtattttttaaaagttggggctggggataatatagcacagtaggtagtatcctgagccagcatgcatgaaaccctgaatgattccctagcactacataaagcagggtatactgaagcacaactgttgttctacattcaggtagagatagaaaaccacaaatgcaaatccatccttacctacaaagtaagtttgagaccagcctggaatacaggggatcctattcctcctaaaaagagcaagattgttgtagaatatttatttacactgtagagatgcgtctctacttaaggcaccttctcgttgatttaatacaaagctaaatggccaatagctaggctagagagaataggcaggacttctggtcagagagaggaagtcagagggacgaatcaaggcaggagagagacgtggatcgagtctgtattgtgttgaggaaaggtaaaaggcacatggcagaatgtagattaataaaagcaggttaatctgagttgagggccaggtggtggttcatgcctttaatcccagcacttgggaggcagaggcaggtgtatttctgttgcgttcgagttccaggacagccagggctacacagagaaaccctgtctcaaaaaactgggggaaaaaaaaaaaaaaaaaaaaaaaggaaagtcagagctgtaggtcaaaagtagagtgcctattttgtatttgtgaggccttaggttcaatccccagtcctgccagtctctctcttttctctctctccctccctctccccattcccctctcttgggttttgtgtagctctgagaaatcctcttgcctctacctcctaagtactgggaatacctgacttcctactgagatctttaaagcagaacaggatgcctcagtgggtaaaaagatttgctacacaaattgagacctgagttcagtttcctggatcctactgtagaaggaacactgactctctgacctccacacaaaaaccatagtaaaataaaaatttaaagtaatacaattatggtaaaacaaacttattctgtataatggaaacaaccaaatttacaatctgaaagttgtcaagcacaagataggataaggagtgtgattcatagtgctgagagacagttggaagtaaggtaaaatgtttaaactagctgttggggtatttggcatgttctagttaattggttatctgctgttataatgtaaaaagcagtgtagtaacatacccagttagtacaggacctcttgtgaaagtaaatatcagggtgtctgtttaagaaaatgtgtggccttttctaactgacacatttcatttgtagtgtctgaagtagtgtaatgagttttggttaatgtcttagtcactcttctattgctgtgaaaagaccatcagcaaggtaactcttagaaaagaaagtattaatttttgcttacagtttcagtggtggttcattgtcaccatggtggggagcattgcagtaggcaccaagcatggttctggaaaagtagctgagatatcacacatctgttccatgagttctaggcagagatactgggccttcaaagcccacccccagtgatacaccttttcttttcttttttggttttttgagacagggtttctctgtgtagctttggagcctaacctggcacttgctcttgagaccaggctggcctcgaactcacagagatccacctgcctctgcctctcgagtgctgggattaaaggcatgtgccaccaacgcccggcttgtgatacaccttttctaacaaggctgcactacatctcttaatccttccccaaagttccactaactgggaatcaagtattcaaacatagactcaatgagaaccattttcattcaaagcatcacagtttcttgtagtttatgtagtaaaggataacctgggagtatttgttgcaatggtgtctctatagcctgaaccatgtaaattaagattatagggacactgatccttgtagtctctgagctttccatgcttggtaagcagcattcaggatgttgtcttctggaagaataagtgctctgatcacggagctaccttcccagtctctcagggtctcctttatcctagactggcctggttctctcattataactgaggatgaccttgaatttctgatgtcttttcctccccaggcctagaattacatatgtatgtcactatatccagttttatagggagctggggattgaacccaggttgtgtgctagatgagctgtctaccaactgagctgcatccccatccctgtggtctcataaacacttaagattatgaagacaagtctggaaacagaatagctaaaataagatctgagttgattgtagattctgtagaatccaaaggaaagcagtccataaaaggaaggccaggagagtgtggtcagttataccaggggctaaagcaacacagtaggttttgtggttagtatgggcagcataatggaaccacacatcaaagataagagaacagaggaagggggggggcaagggagagggaaagctgctagggaaataatctaaacagttcttgcatactattttagatattttctttcttttttttttaagatttatttattatgcatacgacgacgatctgtctgcatgtgtccctgcaggctagaagagggcaccagatctcattatggatggttgtgagccatcatgtggttgctgggaattgaactcaggacctctggaagagcagtcagtgctcttaacctctgagccatctctccagcccagctattttcttttttcaattaaatttattttatgaatatgagtgtatctgcacgtacaacttcatgccagaagagggcaccagatcttattatggatggttgtgagccaccatgtggtttctgggaatttaactcaggacctctggaagagcagccagtgcttaaacactgagccatctctcttgtctgtctgtctgtctttcccccgaccgccccccccccaccaccactcctttgtttctttgagacagaatctctctgtagccatgactggcctggaatttgctatgtgtagaccaggctggcgtcaacttagatctcccagtctcagccttctgtgtgctggaattaaaggcgtgcattaccatacttagctctatttgaaaaaatattctgaatgttttattttgtgtgtcacccccattagatgtttgtttttgccatgatttggaagttttgcttacaatgccttctttgttgcagattttgtattttgtacatacattattttgtatattctgtatatgatgacttcggtgagcaatgatcgttgccgaggtgctcgggaaaaaccacagatgccaacaacacatgcaggacagccacagaaacaagtgatacaggtaagtcttgggttagactaaaagagtgagggagaaggaatgtgttaatagctcctttctagggaactcaggatttagcattgtgtttacaaactaaataagtagtatacgaaagggatgatgtgacgatggtacaatcgaacggtgttccaggagaagcatgtgtttaagcctgaatttcagttgttatctctgctacagcagttcccttccttccttctttgtctcatgttccagtttataccactaggaattaaacccagggcccctgtgttctagaccagcactctactactgaactacacgcccagctcatctgttattctttcaagtgaagtgagacatgttagtacagcacggaacatgtctgtactataatgatccagttgacaagcttcttaacagaaacagtatctttcccccttcatatgttcattattatccttacatttactaaccgtgtgtgtgcaagcttgtgcatgcacacgtgcacatagatcattgtgctttttgaagtcaaaggacagctagagagagcgagttctctccttgtaccatttgaattcaggatggaactcgggagtcagggttggccataaagacccttactcactgagccatctgcttagagatgttgctctgcttcagcttcccaggtgctggggtgtcagacttggactaccatggttcacttttatgatactttgttttatttctgatattgggttgggacatagggttttgcatatgaggcaagtattatatcaaccagttatgtcccttattcttttcaggagcttcatgtaatttcatactgaagtgttctattatgtttggtacagagtagaatttttttttttttttaagattttatttatttattacatatacagcagagggcaccagatctcattcaaggtggttgtgagccaccatatggttgccgggaattgaactcaggacctctggaagagcagtcagtgctgttaaccgctgagccatctctccagcccctagaatttttttttttttttaacaaaatttttgtgttaaattgaatagaaaaatagcttttttttttttttttttttttttttttttggctgctattaacagataaatatctcctatgttagtgcttacccctaagttctttaactctgatcagtattcttcacaaagaaagactgctgtgctgagtgttgtaacacagtcctttaatctcagcacccaagacagaggcaggcagatctctgagtttgaggccagcctggtctgtatagcaagttcaggctagccagaatcgaacaacataggagaccctgttgttagagaactgttgcggctaggctatccttttaagtttagttaatgaattgtcttgaattaatgaagaaatataggtcagaataaccaaaggtgaagggatgatgatgatgatgatgataaagttagtctttaaaaagaaattgtatcattaaaaacaaaaaagtaccaggcgttggtgccgcacgcctttaatcccagcactccctttaatcccagcactcaggaggcagaggcccgtggatctctgtgagttcgagaccagcctggtctaaaagagctagttccaggacagcctccaaagccacagagaaaccctgtctcgaaaaacaaacaaacaaaaaaagtatgtataacaggctttcttttgtgcctctagccagctcccaaatcgtgacaagaagacttgttaattagttatgaatgcttggccttgtgcttattccactagctcttataatttaaagtaacctgcttctctgtatctacattttgccttatggctttgtacttttcttttattctgtatgtcttaatttttcctgtttcttccatgtctggctgtctggcggctgcctgactggctggcccctggcatctccccctcgccctcgttttcttttctcttctccctcctctctcctgagcctagattccttctacttattctctctgcccaccaaccccgcctatccctcttctgcttagctattggccattcatctttttattagactttaggcaggcaaggtgaaacagcaacacatctttacataattaaacaaatgcagcataaacaatgtcacacatttttatattgttagacaaaagcagcataaacaaaagtaatactcttttacttgataagtaatattccataacaagtatgagcttttgaaggaaggccaaataaatgtgaatgatgcaaatggtaccctgtataccttgctagcagacttggatggattgtcagccagtttgcagactagaacagggaattagttttgttttgtttttccttctaaaagggttttatttttattgtgtttcattttcagtagtttgagacagggtcttgctatgtagcccaggatggcccagagctttcgggtatccagtactggtctcaaaactttaaatttccattcctcagcctccctggaatttggactacattaaaagattttcactaatagcctttctgtggagcctttgagggatgacttagattgcctaaaggaaaaagctgctgactgatcaatgaggatgagttcgagatcctcctgcttctttttttgggctttttgtttatttgctttgctttttaaggtatttattcaaaagtaatattacatatatgtgcattttcctgtatttctgtctgctcactgtgtgtgcctgcctgtgacggccaaaagagggtgtctgttggatcccctggaactggagttacagatggtgagccaccatgtgggtgctgaaaattgaacctaggtcctctggaagagcagccagtgctcttaatggctgagccatctccaatgctttttttgtttgtttgtttttttgttttaagacagaatgtcatagctcaggtcggtccagcttgctatatcatccaggctgctgtctaattgaatgcatacttggtttatagatgtataccatcgtgtggcttttcttttttatattttatttatgtgtatgggtattttgcatgcataaatatctgtaccacatacacagttaatagacagttgtaagctaccatgtgtgtttggaaatccaacctgggtccttgggaggagcaatcagtgatcttaaccaccaagccatctctagccctgtttcctgtttttttttgttcttttgttttgttttgttttgttttttaagattttattttatatattatgtatacaacattctgcttccatgtatatctgcacaccagaagagggcaccagatctcataatggatggttctgagccaccatgtagttgctgggaattgaactcaggacctctggaagagcaggctgtgcttaacctcttaacctctgagccatctatccagccctttgttttgttttctttaaagatttattttatctataagataaatatacataataaatatatgctctgtctgcatgtacacctgcatctcataagaggacatgagaggctgggcgttgctggcacacacctttaatcccagcactcaggaggcagaggcaggtggatctctgtaagttcgaggccagcctggtctccagagcgagtgccaggataggctccaaagctacacagagaaaccctgtctcgaaaaacaaaacaaaacaaaacaaaacaaaacaaacaaaaaaaaaaggacatgcgatcccattacatatggctatgagccactatgtggttgtggtattgtaggatggtgagattgctgagtggttaaagctcacaccatataagcctcgagttctgagtttgacaagcccaggaagacacaaaaagctgttttcttttacatgcatgccatggcatgtacaagcctgtactcacatatgttaataataataatagtaaaaagggctttaaaaaatggaatcttatgaagttgccccaagatggtctcaaaaaaattgtcttcaagccatcttcttgtcatagcctgacatgtagctgaaataattaaattttctttttgttcatttttgagatagagtctgttgagtatctctggctgttctggaacttgctatgaagaccaggctggcctgaaactcacagaaatccacctgcctctgcctcctgagtactgggattaaagtaatgcaccactatgcacttgctgataattattttcagatactgctttttataaaattatttggaggatactactaggacatttttatgttagactgaggtgtttcttgcttggtggtaaaacatttgactaacatacatcaagtgccagtttcaagacccagcacaatatacacatgaatacacacttggggatgtaacctagttatagtgaagtacttgcctaacatgcccgaatccctgggttccgtcttcagcaccatgaaaactggccatggtggaacaagcctgtactcatctcagcactcaggaaatggaggcaggagcatcagaagttcagggttatctttggctatagtgtgtttgaagccagcctacgctgcgagagaccccagagagaagagaaaatgattgttaaattatatgttaattacaatataaaaatatttcctgtaagttaccttaaagagtattggttaggatagtaattgttcactaaatggccagttgcagaccttttctgtccaagttaagtgctgaaagagctgttttgagtttgtgtaaacctgagtttgggtcttgggcctacatcattttttaaatttatttatttatttgtttatttgacagggtttctctgtggctttggaaccttttctgaaattagctctcttatagaccaggctgatcttgaactcacagagatcctcttgcctctgcctcccaagtgctgggattaaagccgtgggccaccaccaccaggcctgggtctacatctttattaattaggcaagatagaatttctggagtgcttttgttcatggcaatataacgtctgtcctttttagttaagtatatgtaggcatcagttctctccagtcagtgtctctctttgtcctcctcttccccatgccaactcagtttatgctcagcacaggctgttcctctcagcctccctcacttctgcctcctgaatagctggaatttcaagtttgccattagtaggataggcttgttcttcagtttcttgtcattgacatattaaagagtataggatagttatattctacattatctttgaatttgagtttatatgatactttatgattagaattaattatatacttttggtataagtaaatgtgatctattatttccccccccttttcagtagtaggcatcaaactcaaaagcttgcatatattaggcaaatgttctttctgcttctgaactgtagcctcaactggatgtgatttgtattttacataccatattatgatataataggttctaagtttgttctgttttaccagaacaaagtagttagtattcctctagtgtctcagagaggccaactggttttaaaatacaaaacagttttaattctttgcagaatgattataaggaattagaaattatatacaattgttatcagaaagtggtaattttttgtatatttattccacataaattataaaattattatttgaaatttgaggtggacatggtggttcatgcctgtaatcccagcagtaggcaggcttagaggattacaaattagaagtcagggtcggtgaaaaggctctgccagtaaaggtccttgctaccaagactgacaacctgagtttgaccttgggtctcacaagattaaagaagtgttccagcgagtgttggtggctcaggactttaatcccagcactcaggaggcagaggcaggtggatctctgtgagttcaaggccagcctggtctccagagcgagtgccagcataggctccaaagctacacagagaaaccctgtcttgaaaatccaaaaaaccctccacatgggtactctgcgaggatatgcatacccacatacatacaataaataaattaattttaaaaagcaagatggcaggatgtggtaattgcatacctttaatctcagcacacaggcagaggcaggcaaatttctgcacgttagaggttagcctcgtctgcatatacatagcaagttctaggatttccacagctacatagagataccccatctcagaaaacaatataagcaagtagaaaataaaattatatcaaatattatagaaaacaggtggtttcagggctggagaggtggctcagaggttaggaacactgactgctcttccagaggtcctgagttcaattcccagtaaccacatggtggctcaaaagccatctataatgagatctggtgccctcttctggtgtgcagatatacatggaagcagaatgttgtatacataataaataaataaatcttaaaaaaaaagaaatgaaaacaatgtggtttctgtttaagaaaatatgtatttatgcaacacaaataataataattaggcaaaataatatgcctacagattttttttgttactgttttgttttgagacagtgtcaactatttagagaagattgctcttaaatgtattactaatatccttttgcctttacccccttagttctggtattacagtcatggcttcccatgcccatctataaggatggtttaaaaaataaaatcggggctcagtggataaaggtatttgctgcccagcttaatgacctgagttgggtttttagggcctacatgatggatagagagactctgtctgtctgtcctctcacttctgtgtatatacatgtgtatgaatgggcacatacacagacacaaagaataaaatattacacatacacagacacaaaaatttaaatagtcaaaaataggtcaactgaatattttattgtttaattctcggatgacatgcaaagattgctgtgagttcctggctagtctagtttacatattgagtttctggctaacccatatcaacctctgccccagataaaataaaaattgtaaaccaaggagatattcctacttcaataagttatccaaagatttctggaagaccatccagtgaaagaaatgggttcattagagaatctttcagcatagttttcttattaattaaaaattatatatgtatatggttgttttacctgcatatatatctgtgtatcacttgtgtgcctggtgcccttggcggccagaagagggcagcagagttccctggaactggaattacaaactgttggggagggagcataaaccttgttttaagttggaattattagttgaccctgctttttcctcttttttccctaagctgtacagacctcttgacacttcttgagctcagcctggtaacttccctattatactcttatgtttggttctttgtttattgaataattaaactgtttgttgaataaagtatcttaaggtttgtagagtattttataaaggtaacacaatttaacattttgactgagactattactgttgtaatactgcgcttattaacagctgctaagtgaatcagctgtgctttcagaagttgtctagtctgtactctgtttagaattaaagcaatgatttcacagacaaatgtaaagaatgtttgtaaagttataatacttaaactaaaaaggcctagttttcaatagatcagtagttaatacatgtgagtaagacaaggaatagtgtctttctggttagaaatgtacaaatgaaactttcaaagtgaaaatatagagacacatctagggaataaaatggtgcttgaggccattggtaattattttactgaaaatctttgtccatgcttgttgatgcagatgcctttttaaaattatatattttttataaagattgatttattatgtatacagtgttctgcttacatgtatatatgcctgcacactggaagaaggcaccatttctcattacagatggttgtgagccaccatatggttgctggggattaaactcaggacctctggaagagcagccagtgctcttaacctctgagccatctctccaacccaaaattaatgtttttttttttttaaaagatttattatgtgtacaacattctgcttccatgtatatctgcacaccagaagagggcaccaggtctcattacagatggttgtgagccaccatgtggttgctgggaattgaactcaggacctctggaagagcagtcagtgttcttaacctctgagccatctctccagccccaaaattaatattttatatgatatttttataaggtcaagcaataaaatgtttcttaaagttgtctataattacagataatgaacatttcttaaggaatttttaggcttaaatgttgctgccttgctcttggaggcctagccagtggtggggtatttgcccagcccttagttcattgcctggcaccacaaaacaaaataacattctctataaagccagcagtgttgctcttgtttgttcagactccattagtttttcataccccttttcagaaagataacccccacatttcctggctttgttattctttgtattgttggactctatgagattaaaaacaaagcaaaatatttatttttatcattttaaaacatggggtatgtgtgaatatctgtgggcatgtgcacatttagtgttggcggcaggcaaccttggaggatgggcaggggtggatgtccagtcctctggtgttgcagtaacaggtggttgtaagctgtctgatgtggttgctgggagctgaactctggtcctctgaaagaataaatagcaagtgctcttaactgctgagacatctccagcccctttgcacaatgttattttgacattacgccatgaaatattttctctggaaactctcaaaccaatgcattccatatatatatatataaagtgtcatatacacacacacacacacatatatatatatatatatatttttttttttttttttttgagacagggtttctccatatagttttggctggcttgacctcacagatccatctccctttgccttccaagtggtggaatgttaagtttttttttttctcctctccctttttcaaatgtattttatttgaacattaatattttgcctgtatgtatgtcagtgtactatgttcatgcttagtacctgcagaagtcagaagagggttccagatcccctgggactggagttattgttttatgaaatgcctgtggaggccagaagagggatctgatcccctagaactggagttacagttgtgaggcattatgtaagttctgggaattgaacctgggtccttttaataagagcaacaagtgtttttaaccattgagccatctctcctgtccccacaaatttgattattttgagacagtgtctttttcttctttttttttggggggggggcatgtttgagtcagggtttcactgagtagccctggctgttcttgagcttgctctgtataccaggctggcctacttttacctgccaagttctgggattaatgatgtgagccaccacacccagcctgagacagtgtcttattcaccctaggttggtcttgaattctctgtagcagaggccagccttaatctcttgattccattcatgtacctcctgagtgctggtattataggcatgtacttccactctcatttctggttttgtgtggtgctggggatcaaatgcaaagcttcacgcatgatagataaagtggtctagtgagctagctacatttccacttcatatttgctctttgtgatggtatgtcaatatataacataactatagctctttgtcctccttcctggcaccaactgtgtgtgtgtgtgtgtgtgtatacatacatacacatattacacaagcacatttattttaaagatttgtttatttattatatatagagagttctgcctgtaggccagaagagggcaccagatctcattacatgtggttgctgagaattgaacccaggatctctgcaagtactcttaacctctgagccatctctccaggccccaccatgtgtatttttgtaataattctcatcttgttgccatcgaggagctacatgtgatctattattttacccagttaaaattgtttcctcttttgtttccctttttcttctcggtgagacattgactgtagctcagccagggctcatctcttttagcacttataatacctgtttgtccttttttgtttgtttgttttcttcagagatatttccatatactaaactcccacctctagctccctctccctcataaaaaatggataagttagcttggcagtggtggtgcatacctttaatcccaggactacggaagcagaggccagtagatctctgattttgaggccagcctggtctacaaagtattgtttcaggacannnnnnnnnncacacccacacacacacacacacacacacacacacacacacacacacacacggtaagtgctgggatttgaactcaggtcttcatagttgtgcaataatcactttaatgatccatccatctgtctaacaatctttctcccagtcaggctcttaactccaactatcacttctgtctctgtttttcttttcacttcattatctttgcacttgtagagtccctttactcagtcttcaagtattaaatagccgaagtatttcatatttcatatttcaggtcagtgagatggcttatcatgtagagacacttgatatcaagcctgaggacctgaattttattgtcataacctgaatagtgaaagtagagagaattgaatcccacaagtcctcccgtgtgctgttggattctgacttccagacagacagatatatacacacaaaatcaactagtaagttaaagaaaaacgaaactctgtataccttgcttccttattaaggctacttctgtaatagtccaggttcctgttgcctcattgttggatgtttaaaaagcttactcagtgcctagcagggacatcgtgataaatgtgttttctgctgtatatattcagttttgagtcattaacacagttgggtctggcatgatagcacagacttgagttacaggatcctatctatcagtgaaatagaagttctgtttttggttttgtaattactaaagataagaacttttttgttttctagaaagactgataattgttgaccagatagatcattgttagccctaccttgtttaactgtttggtaactgtttggtgttattctcaagatgccatgcatattttttgtttgtttgttttgttttttgtttttcaattcagagtttctctgtagctttggaggctgtcctggaactagctcttctagaccaggctggtctcgaactcacagcctcccgagtgctgggattaaaggtgtgcgccaccacccggccatatgctatgcatatttgaagggtgttttttagggtccatttttctgtttatacataaacataatttatatcttcaaacatgaaattagatcatgtcatattgtttagttttttttttgcctaatttccttgctgttgactttaccccttgttagtgtttagagaaagtgctatgaacagatatccttggattctttgtttttgtctttgagacagggtttttgtatgaagccctggctgttctggaactcactacatagatcagtctggcctcaagcacacagagagctacctacttctattgtgatcaaagggatgtgtcatgcttggctttttttttttttttttttttttttttttttaaaaaatttttccattgtacatttaaaaactccaatgtagctttggaaccatcctggatttcactctgtaaaccaggctggtcttgaacccagagatccacctgcctctgcctcagtcactgggattaaaggtgtgtgccgtcacctaacctttttttttttttttttttttttttttttttttattgggtttttttttttttctagatagggtttctctgtgtatccttggctggcctggaactcagaggtcctcctgagtgctgggatcaaaggtgtgcgccaccagcacctggcttgataatttttttgtctattgataaagtatgcctatttatgtctttgtttttgatgttactacagtcctggtttggatagagttagaaaagtgtctcctgtcaattttcagagtttgtgaattaggattaattagagaaactgactatgcttttactttgttttcatgatctatttactcattcattcattgagtcttactctgtaaaccaggctggggtcaccatggcccaggtagccctcaaacacattgtaatcctcctgcctcctgcctcggtctcatgagtgctagggattataggtgtgatccaccatgccctacttttctgggaagttttgatgacagtttagttagttaacctattttgagtctccctttttagtagatgatgctccccaccccattcttttttatgtttgtatgatgtgatgtgggcggcacaagacaaaatgtggatatgtaggacatctttgcgtgtccgtcccctttctggctagctggcccttgaacttcctaagcagttttcccatcacatcctttggtagacgtgttgggattatagattcacactattgcatcctgaccatttatgtacattccaggattttttattttgtctaggctatctaatttggtggcacatacttgttctaggtttccttttataatccttcaagtttcgtttttattgttaatttgtttgaggtgaggtctcactgtcttgctaggctgtcttccctcccctttttcagcaccgggattttaggggtgtgttgccatgccttgacatctctctaatgttcctttctcttttacttctaagattactactcttaaatcttgtctctttgtttgtggctgagtattttatctattattgacacacctgactgcctccctccctccctcccaatttgagtcaactgttgagcaagtagtagtactgtacctagctagctcagtagaatcgtaactacctacctaccttgctagagaccctggcttctgtctccaggaccaccaaaaaaacccacaattccccaccccccacccctctacagagtcttactttgtaactcagttgatctggaagttcttacacagtctggggtagctttcaacttgaccagctcctccaactcagtctcactagtgagtatgagtaagtagacccagttgtgaattaaatttaacgtgatcaacatgattgacatcccccttttttctttttccttttcttttctttctttcttttttttttctttttctttttttttttttttttctttttggagacagggtttctctgtatggctttggagcctatcctgacactcgctctgtagaccagggtttctttgtgtagctttggctgtcctagaactcactctgtagaccatgctggccccaactcacagagatctgcatgcctctgcctcctgagtactgggattaaaggtgtgcaccaccaatgcctggctttttttaaatttaaggagtgaatgctttcttctgtttttgtttgtttagttttgagatggggttttcatagcttcagtggctgggattcctgatcctcttgccctgagtgttgagattacagactagcactgccatcgtggctaattaactacccgtgtgtattttaaaagtgtgtgtgtgtgtgagagagagagagagagacagagagagacagagagacagagacagggagagaatgtgcgtgcatgaaggcatataagcttgcatgtgcatacgcataaaggcaagcatgtcatggtgtgaatatggaggttagaggtcaactttgtagagttgttctcttcttttcaagtgtatattagcgttctgggtattgaatttaggttactaggctcatgtaaccatacctttacctgctgagacatagtgctagcccattccctttggtgggtttctacttgttttgtttgagacagggtttcactgtgtagcttttactatgtgaacctcactatgtagaccaagctgttctcacaaaggtctgcctgcctctgtctcctcagtggaaggagtataagcctgtgtttccatgttcatctttttctattggttctgagtattgacctaaggtcctcttgcttgcacaagtacttttaccaaataagctgtcttctctgccccatgacaatctctaaaattttattttcatttatatgtatgaatttttttgtgcttttgtttttttcaatttgtgtgtgtgtaccatgtgtgcctggtactacagagaccagaaggagctattgattgggtttcttgaaactggagttactgatggttgtgagctgctttgtgggtgttggaaactgaacctgggtattcttcaagagtaaccattggtcttaatctcttgagtcatctctccagttcccatctcctaccccactttaaagtgaaagtgatatacaatgctacgaaaagcagtggaaggtgctgtattaatgaaacaggacagactattcctgtggaattttagcatctggaccactcatggctttgtctcactcagaagtgactctcatccagattcaatgtaacatgaaggctccatttcagaggctgtacttccttttggcacttaacatgttgttgagcctttgtctacagtagtgggacttctcagttgatggtggatccagggaatggctatctggtgtgcagtatgaataaatgaaagtgtatttggtccttgtgtatactggaagagattgcattaacattgtcaacaagtatgggcattgagtttctgtacagacatctttctgggtgtaatgcagtagtgtttggcagcatgaatagattgggaggacaagactagcttttagattggatataataggctgcagctgctggaattcttattacccacctacaggaaatggaaaggccttgtgaaaggtgctttatgatgcagaacttgccagttcccccatgcatcttgattaaggttccttgtaatgagtgaaatatgtagtaaaagctgaatggagttgggctgtagttcagttggtacagtgcctgcttagcatgcctaagacctagtatcacataaattgagcatggcgacacaagcttgtcatctaactgggaggtagaatcggaaagtcagaagtgtaagattgtctttgactataaagttagagccgagatttttttttttgtttttttgttttttttgagacattgctttggaggtgtcctggaactaggctggcctcagactcacagagagcgcctgcctctgtctcctgagtgatggggttaaaggcgtgagccaccactgcccagcctttatgagattcttaaaataaacctaagaaaagctttgattgctgtattgactgagaatgtgtcttattctgtcacttaggctggctcctgaacttgtgatcctcttgcttctttctcctcagtcgtggttttacagcacagtgccacacttgaccacatatttaggtttttaaatgtgttcaggagttaatgcagactttagttgagaatgctaatctagccaggcatggtggtgcacaatcccagcgctgggaagcagaggcacagggatctataagagttccaaagccagcctgctctgcttggtgagttccaggctgtccaggaatacacagtgagacaatgtctcaagaaaaaaaaaaaaaaaaaaaaaaaaaaaaaaaaaaaaaaaannnnnnnnnnaacaatggtaatttagggctagtggggagggctcaggtgcttctgacaaatctcacctgagtttatttaccaagactcacatgttggaaggagagaaacaatctccacatgggtgccataggctgccttctcctaaataaacaaacatttagttggccatggtgtttcacacctatagatctggcattctaaaggctgaggcatatgagaattatcttaaatttgaggtcagtctaggttatgtagtgacttccagtccaggctgagctacataataagactgccccaaaatcaactgtgacaacagcaacccaaaaaatagcaacaaaaattctccttccagacagtaaactggacctggaatgatggctcagcattgtacttgctgtataatcttgaggactggtttttggattccagcacccatgtaacatgctggcactcctgggcacaccaggtaaccccagctctgagggacagaggcaggagctttggtgttttcctggcttcctttaaccaaggagacatgggccccacccaggttgtgagagattaactcctcctctggcttgttcatgccacacacctacactgtgcatgcacaagagcagtcaaacagacagtaactgaagaaatgaacatttaaagtaatgctagctttactaaaaacttgtgtagagatatgacagaaagtttaatctcttttacataatttacttgttggcctaatcctggtatttttctcaaggattttggtttttcgagacagggtttcttgtgtagctttggctgtcttgggtttctgtagaccatgttggcctcgaacacacacagaaccacctacttctacctctctgagtgctgggattaaaggtgtgtatcaccactgccctgctatttttctaaaatttaagatactgtataggagccaagcatagtgttgcatatgcctgtatgtaatctcttgactttgtaaattaaggatggagaaagaagagtttaagactgggctatgtagcaagatagctcaagaaagaaaataaggaaaatccagttaggcttagtggcacaatcctgtaataacagctactcagggcctaacaggagttcaaaggccttcttcattacagagtgagttcacagccaacctagggtatctgctttactatctatctatctagagatagccctggctgtcctggaattccttaagtaggcctctaacatcttatttacacagttctcctgcttctgtctctagagtgctgggattaaagtgggaaaggcatgtcctaccaggtctggcttcagtgtaggcaagacttggtctcaaaacaacaaaatgtaaaatggattgagagggatatatatatggtacagtgcttgctagcatgtgtgaggtcctagattcaatttctgttacaataaaaacaaaacacgaaagcaaaacatcaaaccaataccacaaactccaaatgagcatttaatagtgtgtcactgcacaatgctactaatatttaattgttataaataatacagaaggaaaccttaaaattttactagtccattttctcttttttttttctttttttcaagacagggcttctctgtgttgccttggctgtcctggaaccctctctgtagaccaggctggccttgaatttattgattaaaggtgcacaacaccatgcccagcccagaagtctgtttcccatctcccccctcctcccgttccctccctccctcaactcagggtgtcttcaaattctcctgaagaaaaagatacccttaatcctcttgcctctgcctctcaggtgctgggattatgaatgtgtgctcaccacacttggttaatcagtgtttctcaaagtaatacttagtgattgagagttctgtttgactgttgccttctaacatctgtgttagtattttagctgctgaaatccactgctttttttttttttttttttcttcctaggcaacagctgaacagatgcggctcgcacaagtgatctttgataagaatgattcagatttcgaagctaaagttaagcaggtatgtttctaggaaagtatgctatgactgtgtactttattttttagttaaaatattctgtggggctggagagatggctcagggttaagaacactgactgctcttccagaggacccactttcaattcccagcacccacatggcagctcacaactgtctgtaactccagttcctggagatctgacatcctcacagacattcatgaagacaaagcagcaatgcacacaaaataaacgtttgttttgtttgttttgtttctctgtaacaacagctctgactgtcctgggactcactttgtaaaccaggttggcctctgcctccctagtcctgggattaaaggtgtccaccaccaccacccagccgaaaaataaattatttaaaagaaatattttctttatgaattaatgtgttttgcctacattatgtatgtgcactgcatgcattcttgttatccagctataatgcatgcttaagttttcagatacaatactatgtctaggagagtagcttgtgtggggtgtaactaataagtttgtatgtgggatattctaatgcaattcatgaatggtggccatgtacaagtgaagtcccagttaatgttttaggaatcaaaactttgcaagttctatgctattgacctaagtttaaacatgatctaggagttctgagaatgttgtctgtgcatatgttgtgctgactagtaggctgggggttgtggtgcacacctttaatcccagcactagggagacggagataggctgatcactgtgtgtttgaggccagcctggtctatgtagcaaattgttccaggccagttgatttgtgggtgagtctactagttttattggggagtatgggaaagtcagcctgcacttagagcctagacttactggagtctaggaaaagctctcatgtgggaggacagcatgatgctgtatttgaatagaagaatcagcaaagttaatattgaatgccactttttggttccctttaatcatcttctgatactttgatagcttatggaagtgacaggaaaaaatcaggacgaaagcatagtggcccttcacgactgtaatggagatgtgaacaaagctatcaatgtgcttctagaaggagactcggacacagtaagtgttatttttcctcagtttcaccttgtatggaagttgttgtagaggggtcggggcgtgctgtgttttggagggggtgttctgggaaataaacctaggttcattcatatgtgagacaagcactacaggaaagttccagtaacttggtattccttcagcaaaacagtttctactaccctggcccttggacatgaacatcaacctaaattaccccagctcttggtactaacaccccctaaagtgccccagcttaaagtgctctggtttgtggatattaacaccacctagagtaccctggcctatggacattaacattgcctagaggaccctgtcctgtgtacactaacaccacctagagaaccccagcctttgggtactaacaccagctgaaaacccggctgcagactgctcacagtttctcatctcagttaccacctctaacctcctcccaccccctcattggtttttttacttttgctcaggatagtctcaaacttactctgaggatgacatggaaattcttaactgcctgcctcctcttcctttgtgctaggattagaggatccaccacaagactggggattaaaatggtgtgtgtgtgtgtgtgtgtgtgtgttatatgtgtttatgtatgtgtgtatgtacaccaggtaagtgataccctaggaatagagttttgggtttttataaactgccatgtacgtgctaggaactgaatccagattatctgcaaaaccaacttttttttttgagggggggttgttttgagacagggtttctctgtggctttggaggctgtcctggaactagttcttgtagaccagactggtcttgaactcagagatcctctgcctctgcctcccgagttctgggtaacaagtaacaagtacttttaaccactgagctatctctccagccccttctgacctactcacaactttagactaacagaaaaccagggtttgctgataacttctttattaatggatattccataagcatcttctcatgaggcttaaaatacagacacttataataatcacacagagaaaactgtaaaaggcggttatgaactttattccctttatctctatgttgaaattggattgtatttggtttgtatttctaaattgaggaacctatttcagggcaagttaaaacaaataatacttcacctaaaagaaagtttattgatgattgtacccaaaatgattttcttggttacagagttggcttggtggttaagaaacctgagttcagtttctagaaccctcctgtgttagttcacagtggcctgtaggtccagctctccttttctgaatgcatttacgtacacatgcacacatgcacaaaagcctgactttgttttaaaagatttatgtattttattctatgtgtataggtgttatctttgtatgtgtatatatgcactacttgcttgcctggtgcctgtgaaggccagaagtgggtgtcagatcctatgggactggagttatatactgttatgagctactactgctaggaatcagacagtacccttaggctgagctgtctctccagcccctatacacacatagttttaaaacaaatacatatagaaatatgtatatatttctttttgtcctttttgagatttgtttttagttttattgtgcacgcatgtgtgtgtgcgctcatgtgtgcgcacgcatccctacaaaggtctcagttgtcagattccctcagagctggatttacaggcagctggagccacccaatgtgggtgctgggaattgagccgtccctccaagttttgtctttttcaggaaagtagaactaaatataaaagaattaaaatgtagggtttgaaaggtgtatgacattgatgactgtagaactctttttgatagacatcatgggagactgtaggggggaagaagaagaattttggaaaagaaagctcagaaaacaaagaaaacagagagaagagaactgagagagaagcaagtcgtggacggggaagcagcaaccgaaaaggaagaggtggcaacagaggcagagagtgtgagtacagcttttctgcttagcatttccataccctcagagagctgaaaggacagcccagagaaagcccatgaatccatctgtacgtgtaaatttcctactgtaatcactaacagtggtctgttaggtgctgtgatggggtttcctgtgagtgctggcctgggctacaggtagttagttcattttttgcatcctttaagactggtttctggtctgggcagtagtagccatgcttttgatcccagaacttgggaggcagaggcatgaggatctctgagcctggtctacaaagctacacagaggaaactctgtccatgcaaaaccaaaccaaccaaccatccaaccaaataaaacaaaactggtttctgttagagatcaagtgaactggggttggagtgggtataggttcattcactgataaatgaactatttttttcttccccagttacagacactcatagtatagacgtggatcaaattaataataggtatgcctttaatcctaagcagagtcatatggatctttgtgtttgaagccatcctggtatacatcgtaagtcccagaccagccagggttatatagtgagacactgtctcccccctcaaacaaaacaaacaaacaaacaaaaacctaaaggagataaatttaataggcagggctttttatttagtttaacctccatttaaaaatagaactggtaaaaatagggctcagtaggtaaaggtacctgccatgcctgatgacctgagttcaatcccaggaaccatgtaggtagaaggcgagaaggggacaacccaaagttattgtccaagctccgcaatgtgtgccatggcatgtttcctgtggatccatattttgacaccattttacttggaacagcccaggagacattttataattagtttattccattgactgcttgtgtcgtgtggagacctatggtactgagaaaaacagatttttttaaaaagttgatagcctggtgatgcaccttatcctagaatttgagagcttttagtagggaaattgaattcagggcccagcctgaattcatagtgaattcctgtctcaatgcccctcccccctttttttcctagttctcataaaaataattagtttaagtaaattctccttcctccagcagtgaaattacagacacccatcactatgccttgctctaaatttttgtttttggcattaagtaaactcctcctcctcttctttagattggttccactatgtagaccaggctggccttgaattcacagagatttacctgcctctctctgtctcttgtgttgggattaaaggcatgcactaccactgaccatcagcctggttttaaatttgatttaaaaattacttttaatctatttattgtttttttgtggatacatatgccatggcacacatggaggtcaggaaacaccttcaggttgtcctctctctccttctaacatgtgggtcctggggttgaactcaggtcttcaggcttggcaggtgcctttacctattcagctatttcaccagccttatgtttttattttcctgtatttatttatttatttgtttttgtttttggagacagggtttctctgtggctttggaggctgttctggaactaggtcttgtagaccaagctggtctcaaactcagagatctgccagcctctacctcccgggtgctgtgattaaaggcgtgcactgccaccagccttatttttatgtgaaggttaattgagtggtagcattaagaatgagaagtatttatgcaatagaaatgtagaatttggtgatggggattgaatcaaagcccttagcttgaactcttctttagccacatctctatgtcttatatattactttattttattttactttttgactacatgactttactcatgtagccctgactggcctttgactcacagagctttgctagcccctgatacccaagttctgggattaaatgtatcatacctggccttatatgatactttaataatgtcacatagaacatgttatgtggggaaatacattcagaaagaggtggagattatgggaagggatatggtaaatttaaatgtactgcaaaggaagcctcactgggagctcatgtgagttaagtagcagctagagtgaagagagttaatgatgccaaaatctcttgtcaggttattttttttttatgtgcaaccatttaagccagtatgaatatgaaaaatgaaaaacagtagtctttgcttgcctctttctgggtagtaccttttttaaaaaaatttttttttaatttgaattagaaagattttcatgtcaatcccagttctttcccctcccctcttcccctgccccccccaactaataccctacctatcccaaatcctttctgctccccagggagggtgagggcttccgtagggggtcttcagagtctgtcatatcctttgggatactgcctgggggcaggggtctaggctcagggagtatccctcccaaagtccattcctatgctagggataagtactgatccactacaaggggccccatagatttccgaggtctcctcactgacacccacattcaggggttctggatcagttccatgctggtttcccagctgtcagtctggggaccaagagctnnnnnnnnnnnnnnnnnnnnnnnnnnnnnagacccgagctaacatggggttagctcgttaaacaacaataaagcctcatgcagtttgcatcaagtttctgcctccgcatggtgattggggtggccgctgttctgggctgagatcctggaggcctgagcttctgggggtcttgcaatataagtcagtcatcaatctcattatcggggaagagcatttaaggttgcttagattgttagttggtgtcatctttgtagctctccagacatttccctagtgcctgatttctctttaaacctataatgtctccctctatctgggtactaccttaaagaacctgtctctttgacattaccttttacaatgacactgcgtgtgtgcctgtgtttgctacgtgatattactgatttaaacacttttacagcctttaattaagaaataaattttgtgatgtgtaacatcgttgcataatgcgtgtttgttttgttcttactgtttaaaaaaatgtattttagataagggcacatccatgcagagaaagtaaaattactatgttatctattggatgtcttgttgctctatatgtagaccaggctggcctcacagagatcctgtttctatcccgagtgccgtcattaaaggcatgttccaccatgtccagcaccgtcttattttaatttaatttgtatatctgtgatatctggcatgtgttgccattcattttttttgtggacaccccccacctctctccgccctttgagactaagtctcactatgttatccaactggccttgaacttacgattctctttgttccaccatcctaatgatgaaagtgtttggtcttatgcttccagttttgtggtactttgtacttttttttttttttttttttaaagtatacagtattctgcctgcatgtgtccttcaggccagaagagggcaccagatcttattcaaggtggttgtgagccaccatgtggttgccgggaattgaactcaggacctttggaacaacagccagtgctcctaacctctgagccatccatctctccagccccttttcctagtttctaaatgttgtttacatcctaacctgctgttggagacacagtctcccttgtagaccaggctggccttcaacttgtgtgatcagaggagagtgcaaccatgcttcacatttttaactttttggtcattatgtgtttggttttgttaagtttaagtgcctgagaagtttggtacaaaggtttggaaatgaaaagttggcatttctgctttttcctctttagtcaagggtgaggagaatggaattgatagcaaccaaggagacaaaccttcagagcgaggcaagaggggccgaggcagaggtaagggagaatgatccaaatagaatgctgggcacgttattgttttgttttgttgtttgtttttttttttttttaattttactttggttctgttattttggtgttgaagattgagcccagtgcctatcctggataagaatgtgctccgctgctgagctacactccagaccctggcatcctattgcttattgcctcttggattctgaaaaccacttttatagtcaggtgtggtgggagtcaggcaggggctggagagttctagtatacatagactgtcaacaaagcaagaacagcttattctttattttgggcttttgtggagttttgcttgtttgtttttgttgtttctagacagggtttctctgtccacccctggctgtcctggatatgtagaccaggcttgaactcagatacacctgtctctgcccctccctctcaggttctgggattaaaccaccactgggcaatatttatttacaatgttttatgtgtatggatattttgcctgcatatatgtccatgtgctatgtgtatgcaggcctgtggatcccagaagagggctatggatgttcctggggactggtgtacagtggttgtgagctgccatgtgggagctggggatggaacacaggtcctttgaccagtgcccctaaccactggacccctctgtctagcacttgtcatttttactttttggtttttcgagactgggtttctctgtattaattgttctggctgtcctggaactcactgtttagagcagactggccttgaacttactgatctgcctgcctctatgtggattaaagtgccaacaataaaggggtgtttttgttttgttttgttttttaaagagtctcatactatagtctaggttggtttggaagtcactatgtagcccagattggcctgaaactctgcttgattaaatcattcaacaatatatacatatacaaatactactgtattccacaattgtgttttctaaaggatttggacgtggcagaggcagaggggcaggaaggttctctgctcaaagcatggggtaagtcacagccatcctattgttgtagttatttcctagttattctacttttctctccctccgacctgtctacaacttattgatcacacttagagcattaatgttgccagagatattaagtcagggttctaacctttgcactgctggcagttttacttggataatgctttattgggatgatagatttcctgcacaacctttcagtataacccctcacctccatgaagtcattaaaatgtctgcagacaactgccaaatgtcccctagggtagggatcaggcatatgtgcataattatcctgagttgccgagttgaaagccagctaaatccagccattgtacacaaaatatgttcttgtaaaaataatacttttatcctgagtgatagtagtaaaggctgactgttctaagtaggtgttacaattgactactattgtttctaggtttactctttctccttgtttttttgtgtgtggcaagacaactcagatattgagccctaaactttaaattggtagcttttatgtttacttcaaattcttctgtgtatattggaacattggtacttattttgttcttcgttaatcacctgatcatgatgccttggggatgttctgttagaacataattattttttacatttttatgtgtatatactgacatatatgctgtgtatttgtgaacatatgcatggcgtccgtatggagtcagaggataacttttgaaagtcatcctgtccttccaccatttgtgtcccataatagaatttagcttgccagtcttggcagctggtgccatctcaccagcccttcagttaggattgtttttgtttttttaaaccaaggcttttctttttttttttttctttaagatttttatttattatgtaaacaacattctgcttccatgtatatctgcacaccagaagagggcaccagatctcataacagatggttgggagccaccatgtggttgctgggaattgaactcaggacctctggaagagcagtcagtgctcttaacttctgagccatctctccagccccttcagttaggattgtcatgcaaatatagagaagtgatgaacaaaacatagctatagctgtacacgaagaagaatataattccattcaaagctaggttgggggtattggtgaaatggttcagtggttttcttggagaggccttgtgtttggttctagtaccccggtaccacattgtgcctcacaaccctttgaaccctagtttcaggggatctgatgcactcttctggcctccatgggcagggagcatgcgcatggtgcatatatgtgcatgtaggtgaaacacttgtacacataaaataaaaatgatggcacagacccatccttaatcctcagcacaccaaggcataggcagacagatctaagtctgtaagttcaaagtccccttagtctacatagcaagttctgggacagccacgtgacattgagagaccttatttcagaaaactgacctccccaaataaacctgccaagcttagagtccgacacaaggaaaaagagatgtattaactgttgatattactgctcattggagtttttttgtttttgtttttgttttttaaccattctaagaggtttattagtaaagagtgggaaatggagaggagggagtaggtacaggcctgtctggaagaaatacagggagagagagaaattggacggtttttaaaagatgatttttgtgtgagccttgagtattttatttgtgtaccatgtgcaggaaggtgcctgtgagacctgaagatgttttcctaggtactggagttcgcaggtcaatttgagttgttatgtgggtgctgggtattgaacctgctgccaagtcctacaaggagcagcaagtgcttttaaccactgagccatctctctaacaccttccttgacaatttttttcctggtgttctttcttggctggaaaagcttccaggtctcctaacttcttaggatgccaaggatcaaactgttgaaacctgagagccatttctacaggagtagatatagggtccagaagtagccatttctttgttagaagatatgcatgcttggctggagatgtagttggtttagtgccttcccagaaagccctgggttcagtccccatcatatcataaagctggacatgctggtacaaacttgtatttttatgaggtatccaccaaagaagattactcagacatgtgttcaagccaacagaaagtctttattagctagccagcaactactctaggtatttgagacaccttgcagccctgcgccttttcttaggttgagcttttttaagcataaaaaaacacatcctctcttggcatacatcagttagccagaagtggaaccacagaaagccaaaatcaaggtttgatggattagatcttattcttgttttggcaggtgttgcctatgtgctgggttccaaggcttgaatggtacttctattatggtatcatttgttttaaggtctgggggcctgttaacagtatcagaagttcaaggttgtcctcaattacagagtgagtttataggcaacctgggatacatgaggcagattctgtcttcaaaaatgataaaaaggagtggagcctcatgtctttagtcctactacttaggaggcagaggtaggttgagtcttgccagcactacatatccatagtgagaccctgtctcagaaacaaaattaaaacattcacatcattgggcctaacaggtaaaggtgcttgttgctaagacttgtgactaagtcctgtctctgagacccttatggtggaaggaaagaacctgctccccataagtatgcgatagcatgtgtgtgtgcccacacactaaataacagataaaaaaatctgtatcaggctgtttgtgttggcataagcctttaattccagcatttgagaggtaggcagatttctgtgagttcaaggctaccctagtttacttactcagttccaggacagccaaggctacattacaagactgtctcaaaacaaacaaaatcttcattataggggttggagagatggtttagcagttaaaaccactggttgcttatccagaggtacctgggtttgattcccagcacccaccagcagcagctcataaacatctgtaactctattttacagaagtcctggcctcttctgatttaaatgaaatccccattttctggcctctcagggcacttcaagtaggtggtgcatagataaaacacccatacacataaagttaaaaaaaaaaaaagtgtttaaagaagcaacatcacaatggcttaaaagttagctgtcatcaatcaaatggtaggagggagaagccttttacagcagccctttgaaggaacttgagcttatttggtttggatttttttttttttttcctctttttgtttttagagacagagcctttcaatgtttctttggctgtcctgatgcttacttttgcctccccagtgctgaactaaaggtttttcgagacagggtttctctgtgtaacagccctggctgtcctggaactcgctctggagaccaggctggccttgaacttctagagactcacctgcctttgtctcctaagtgctgggattaaaggagtgtgccaccaatgcccatcaaaatttttttgtatgggaaattttgtacacagtgtttattttgtgattttgatgcttgctttagttgcctgtttgtttacttcaaaccccaggacatttaaccctgcagactattcagagtccgcatctacagatatcaatgggacaaagtcgggggtttgtgctcagaatggtacagatgagggcactggtaagtgttttgatttgtctgaagtctttgttttgttctatgtctgttcttgagaaatgatctcactatatagcctgagttggctttgaactttcgtggtcctcctgtctcatattcttgaactctgggatttcaagacttaacgatctaacctgtcttcaaagactttttttgagagagagagagacagagacagactgactgactgactgactgtgagtttaggtgcctgtagaggagagaagagggtgccacattcctcgaatttctgggaattgaatgcaggtcctctggaagaacaaacatccttaactgccgctagagatggttttaaaatgttttgttttatttgagtatgatggggcatgacctgtctgaagttcctgaatccaagttgggtatatgtgcttaaccactgagccatctctctagtcctgcctttactttaaaaatgtgatgaagtcctgttttctacctgactttgaaccttcttatcttcttatctcagctgctgaagtgctagaatcaggtgtgtgcaaccactttcagctaggagaagagtttaggattttttatgtttattggtgtttttcatgcatgtatgtttgtgggaccacacttgtcagtgcttgagtaggccagccattggatcccctggacaggtgttggtacactgacatttaggagcttgggattgtactcaggtcttccagaagaacaggaactactcttaactgtagagccatctttcagtccttaggagaaaattttactgaaagtgcttagtattctgggtggtaactgttaaaaccttaaaaaaaaaaatgcgtgcgggctttatctatctatctatctatctatctatctatctatctatctatttattggggggcagttactctgtataacagtcctggatgacctggagacccacctgcctctactcgagtgtgccagcagtgactagctatttatttattttggtgtttttgagatagggtttctctgtgtagcccttgcgctgtcctggaacttgctctgtagaccaggctgtcttagagctcagaccgacttgcttctgcttcttgagtagctgggattaaaggcatgtgccaccatgctcagctttttgtattgttttctgaaatatgtaagtaaatagttgttactgtttgtttacctggagatcttctggagatgagtttgtggtagtcttaactactgaagctatgtttatataaaaatataatttatgcaaaaattagccactaatgacccaaaataaggaataccaaactaattcttcctccacacctggaactttagttgagggctataattctcctggtaacatttggacagtttcatagagctcttgcagcagcacttccatgttttcctgctccaatctggtttatgtggtactgggattgaacccagtctttgcacctgtgaggcagacaatccaccaactgaggtacattcccattcccaaacagaacatggaaagcaattgtaataacctcataaaatgtgatgcgcagttgtttgtcgtacctaatgcctcttaacagtatttaagaagctgatacaggaggattatgtaaattctaggccaacctgggctgtagtaagatcttgtctcaaaaatcacatcaaacaaacaggaaatatccaatgctaagtaataaatctaatggtaacaacagattaacaaacttgtatctagaaaaatacttttaaaacaggtaaaattggaagtgacattatggactttaaaaaaaaagaaaaacttatgtaactgggcagtggtggtgcacacctttaatctcagcactcaagagtcagaggcagggagatctcttgagttcgaggccagcctggtctacaaagctacacagagaaaccctgcctttaaaaaaaagaaaagaaaaaaacccttatgtttgtgaatatttttccttgtatgtctgtgcatcattgcatgcctggtgcccacagaggtcaggtgagggcattggcccactggtactggagtcgcagctggttgtgagcaccaggtgggtacttagcattgaatcgacatcctctacaggaacaagtgcttttaactacggcatgaattttccagatctaaagaacattttttaaatcctgttataaatttgaatttttaactggctcccatctttgcatttagtaatctatagtgatccttcttgtaaatgtctagtatctttaacaagttgaattgaaaaatatgatttattgaactgggcatggtagcacacacctttaatctcagcacttgggaggcagaggcagaaagatctctaagttcaagagcagccagggcttgaaataccatatcaagagcagactccccccccaaaaaaaatcagatttatatagttcagttggtagaatgcttacacagaacccttagtttgatactagtattgtttaatctgggctgggcatagtggtatatgcctagaatcccactacttagatacaggcaggaagatcaagttcaaagttatgctaggctgcacagcaaattgaaggtgagcctggtcatgagacactgactcaagaacagatttattagtaagtaatttatttgtttttgaggggaggcacagtattttttaagtgttattttgagggtcttactctacagtcaggctagcctgaatgtagtgcaggctggcctggagctcatggagattctcctgcctcaactcctttagccctggatttatcattttcagctttattatttatcttactaacttgtttgcatgtatgtgtgtgagcaaatgggtgtattcatggagatgaaggagagcatgtgagtccattctgttcaccaagtggatactggtgattgaactcagggttataaaccttgacagcaagaacctttacctgctgagccatcttgctgacccattgagatctaatttacatacaatttctacaggcagaataagttgaattctaacatgcatacagaattgtaaccataattaaaattgagatggtgtttttctagtagcaataaataattacaaataaactaaaaatggatcataatttaaaagcttgtagcatcttttgtggctggggatgtagctcagaggtagggcacttctttccatgtgcaaggcccagggatgtatccctagtattgaagaagtaaaatgtacataatgtatgtgaaagatttgtttgtggagaaattcaacacagtttctaccaaaaggggcaacatgtttagtgttctggagttggagatatcattattgctgcaacctggttttctcctcaggatgataggtattgataggtagcttcagaatagattctacttcacatcttagcagtcttctgccttcatcctaaaaacacaatggaagagtatttacagtaagccaagcaattgtgatgaaacaaccaagaactcaagaacttaatctcaaattatagtaataggcagcatggaactagcagaagtgtatatggagagttgacaatgtacctagcggggatcatgagtcttctgtctagctgactagagcaaaaattttacaattcagggttgttcactacagtgaatacagcagagcaacggtccaagtgaggcttacatgtattcacaaagaaggcaggaatgaatattacttcaggataggcaaagataatctcagtaagcatgagtcattaagtgtgtgtgtgtgtgtgtgtgtgtgtgtgtgtgtgtgtgtggtgtggattcttgtgcccatgtgtataactctagaaaccagaactgggcagggcaccatgtgtcttttattgctctctaacttttattgctctctaccttcatgagtgggtatgaagaggtcagaagactttctaccagtaggttccaggaatgaactcaggacatcaggcttaacagcaagcacctttactttcttagccattttgctggctccaatagtttgatttgtaaatcaggcatagtaagacatttaacagttagaacttactaaatgaagtaaaaactataagtgttatatgaatgttcttgatgttttgttcctagaattttccatttaatgtttttgggccgtgggctctccctgaaggggactgctgtgtgatacattaactttatttcaagtgctgactttctcttgtttccatcattaaaagctttccttttgatccacagaagggatgggaaagcctcacagtatatctcaggagctgccaaataaaaggtcttatggactcaaaggtatgatggatgttttgttttgaaattttgcgtagataagaatccttcagaaccaagtatgccatccattggtagagtggtcccccagggtacttgagatcccaggtttgaccccagcactgcataaagtaggtgtggtaccgagtacaggtagtgcaaagtttgaggctagactcaaaagaagaaacctgtgagccagtcaagtaatgctaaaggcatgagttcccaatcctgatgagtttaatcctggggacccatagatggagagaattaacctttacaaattgtcccctgacctccacattcatgctgtgacacctataacccatcctactcccaccacaaaataaataaaactaataaaattttgaaaacttaaagttgctccattcctatacaaagtaacgggtttcagactgagtgtagtgctgcactctttgaatctcagcactctgaaggcagaggcagatagatttctgagttcaaggccagcctagtctacagagggagttccaggacagccaaagctgtgtgataagaccctgtctcagaaaactaaaacagaaagaaagggaggggaagaaggagtgtgagggagggaggaaaggaggaaggaaggagattcattgtgtcatttttatagaacaactgtgtatttactttgttcttacttatctcttccctatggctctaccttatactccttgcttctgggcttttagtttttgacctgggactgaagccagagcattgcatatactgtgcaaatacctcaccagtgaactataatcttagttagctcaaccatactgtttgaaactgaaaataatgttatcaaagttatcccatgtgttttggggtataggaccatagataggaaattgaatcatttgtatgaaattcttactgtgaagtttgaatgttctagaattaagagtctgagctcagtccagctgtggtagattctagcactcaagaggtctgtgagttttgaggccaacttagtctacaaagcgagttccagagccgttacacagagaacccttgtctcaaaaaactggggggaaaaaaagagtctgagttcacctatttccatagcatttttatactacagtgtgtatggcaggctattgcagcatgtgcctctggctttcctatgcttttcttcacacatcaattcatggtgctacatctttcctacctacaactatcattatgcatgatgtcttcctgcttagaaacaaactcattttctcacctgattatgcacagcttctttgtgttaattttaaaattatttccctgctcctctggacttagaacaggatgacagttacagtaatgacattgtgtgaacttggttggaaattgtgtaatgtagcaattatttttttttaccttgcttcctatatctgataatcgctaaagtcactggtacaggttttcattacaaaggtgttctaattatatgttcatgtgggtatatatgcacaaatacacatgcatgcggaggctgaaatcaaatttgggtgtcatttcttaggagccatgcctgttgtgttttgagatgggctctctcacttaggttggggccttcagtagtctaaactggcctgcctgtgagcctcagggattttcctgtcatcacctctcaaagatcaaacatgtatctgcctgtttccgaacaccaactttggcttgatcatgctcagcttttacatgagttactggaaattcaagctctgttctccatgctccattctctagtactcgtcttacctgttcccatagcccttgaattcctccccccgcttttttttaacattatgcgttctgagaattgatctcaagttcttatacttccacagtgagcacttcattgactgctaactcactaactcctatagtttattattatttttattttatgtatttatttacttattttttagggggtttctaggcagggtttctctgtggctttggaggctgtcctagaactagttcttgtagaccaggctggtctggaactcacagagatccgcctgcctctgcctcctgagtgctgggattacagacatgtgccaccacctccctgtttaatttattattattttattattattattccagtattgagaaattaaaccttgtgcatgctagacaagcactgtatggttaagctgtaacctgccctaatgatccattttattcttttttttttatttatttgtttattagtatgcttgcattttcttacagcagaattgctaaaatatttcttaaagtgcagtttgaggcattaattttattttagtgtatatagttctgggtatttttatagagaattcattttttatttttattaagaatagatttaaggaaataatttttcttggattggtaattactaattactaattagttgaattagtaattagttgaattagtaaaattactaatgagttgaattatttttcttgcataatacacaaactcattagtgttgaagtttctttccagctaggtcactttgctgtttttcagccccaaataagtacacagagatatattaatcatcaaactgttggccgatggctagggcttcttaaaactatgtatgtatctatgtatctctacatggctttatcttaccagagaacacttggcacgtcctatcttcccagtctctacatggcgtctacttcctctctctccttctcatgcctatacttcctgcctggccaatcagtgttttattcatcaaccaataagaaaaacatatatacagaaggacatcccccatcacattagtagtatggttgactgtactggacctttttttattccctgtcaggtgcctggaaaaattctgtggaagaatggacaacagaagattggactgaagacgtaagtgttcattcagacctttcttcctcctgctatgtcttagcatctctcagaaaaagcccagtgccatttatcttgtctaacctgctgctactgctactacgcttctttcccctcctcccccctcctcttctgcctctgtcccttgttctcaaagagttgccttttcaacacatggttctcaggttttttttattgttgtttgtttctttgttgatgttatatgtgggcctgaatgtcctggaattctagaccagactgatcaaactcatggagatccttctgcctctgcctctcaagtgaactctgaaatgttgaagctgctcacctaagtcataatttaaacactctgtaactccccccacttgccccctatgcgtttcactgtgtggccctgggtgtcttggaacttgctttatagaccaggctggccacttgcctctgcctcctgagtgctgtgattaaaggcttaagatactggctgttttttaaaatcttttatttggtggtggtgaaagaaccgagcattcaagtgttaggtcaagggcaaacttggtaattgctgtctcaggcacacatgtgcaggcaaatattcaaataaaataaaaaatgaatctaaagataataagcccgtggctttcaaataaagattactaatcaatgaaagagaaaagacatttttctttggagaaaaaaaatcatcaaacttttcaaagtttcctgcttttttagcacattcattgatcagtggtgtttcaagtggagtactaactaatacttgaaggttggccccctttgtgttaagttgttccttcacgtctactgatgtagttgcctttcttggggagggttagttacttggtggtttttgtatgagtcatttcctttagacaccctctaggtgataagaacactgctgcctgaaaagggctccagtcaaatatgctttgcatatgtattgtacagacaaaagtaaagttttttctgttgaactttccatacagctttctgaaaccaaagttttcactgcctcgtctgttccagcagagaaccacatcacccctgggcaaaggtaaagggtttttgtgtttttctttttatcttctttttcattcgaagcataattgaaactttgttttagggcaactatttccatcttttattctactcttacagtttctgttttattcctctaattagcctttatttccccttattgcagcactcataacttcattcacatgttatcagtcgtgtccaatgattattgaatgacacttgttcttgggatatgttagcagttggccagagagtatactaaacctagttataattcatagttactcttttaataaagttttgattttgcccttgaatttggggtcttactttgtagcccaggctggtctagagcttagagatcttcctgcctctgcctctggagttctggatgtatatcactattcccgcctaaaacagtttaaagactaaactttagtaccttatattctttagtttcttcatgcatttgtttagatggtctctaacctaattcaaacttgccattttaaatggacatgttattataatgtgccaaattccagcaaaagaaggcctttgaggttaaaattatttgtgtgtgtgtgtgtgtgcgcgtgtgcgtgcgtgcagttgtgtagaggctgtgttgtccttcagaagggctgtctaccctggggggaaaaaacattgttttacatttatgtatttttatgtgtctgagcttgcatgtattttggtgcaagagcatcatgcccatgtgccatagcacttttgtgtacgaggacatttccataggcttacagacgtggttcaccatggtaattctaaacacctttgataatggtgataagggtctgtgtgactggctcctgcagcttgttctctgaccttaatataagcatgcaaacacatatgtgcacacatgctctaaaggtatttaattttaaaattaaaaacattttaaatgctaaaaagtttaaagcctagatatgtgtgtatatatatatctttaagaagtacaagagagctgggcagtggtggctcatgcctttaatcccagcccacctttaatcccagcactcaggaagcagaggcaggtggatctctgtgagttcgagaccagcctggtctacaagagctagttccaggatagcctccaaagcaatacagtgaaaccctaaccaaaaaacaaaaaacaaaacaaaacaaaaaaggaagccctgaatcttcttctcaaaaccaagctaaatgagacagggctttattataggagagaaaaagttcatagatcttcgttgagtttataactaagtgaaaaatagctaatttactggtggtactttaatttctcaaaaaaaaaaaataataattgagagctggagaggtggatcagtgggtaagagcacccaggttagattctatcactaacatgtctggtcatcggtctccatacttccaattccaagggatctgctaccctcttctgatctccatgggtgccaggcataaacatggcacacagatacatatacatagaaatgaaacactcatatgtaaaataaatgaatatgagaaaaagataattgagttaggcatgatgttgaatgtctttaattttaatattcaggatggggaggtagaaggatcaggagttttaagcaaggctcacatataaagtaaacgggaagctaaccttgactacctgaaaccttatgtttcaggtggtagtgcatgcacacctttcattccaccacttagaaagtagagaccagaggatctctgtgagtttgagaccagcttgatctataaagcgagttccaagatagccagagctgtaaccagagaaaccctctcttaaaaaatgtaccaaacaaaaatcccaaccaaaatcgcataaataaaaaatgcttaaaacaaacaaaaagaagccgtcgtcttcacaaattttcaacacagctaatcagatggcaccagggactgcaaactccactgctgccagtgacgattatccttagccactcacttttatttcagtgcgatgtgtgtttgagtttgtttgtttgtttgtttgtgtttgcgtttgttttattccagtgcgatgtgtgtttgcatttctttgtttgtaataataggtcctcactttgtaaccctctggctgtgttggaacctatgtatgcaaggttggccttgaactcaaagatccaactgcatcagcctctcaattgctgggattaaaggtgtggctcaccaagtgtaatgtacttcattcagtatggggtcttcaggagtacgcccattagcaagtcatgaagaatttattgctcataaattcttgcagtaatagctggaagtagaagacggtctttatccaggaaacaatgatgtgatggtttccaagcacatatctgatgattctgtgtggagctcagctactgagtttcctgggccgagatcaaacttctttactcatcagtgagcaataactggaatgaaagatttcttcttattcattgtgtgtatgtgcattttattttcattttgggttgtaggtgtgatgtgccaccacacatgagtggaggtcaaaggagagtttttgagccttgcttgtctccttccaccatgtgggtccctgcagttgaaatcaagtttgtcaggctttggtggcaggtatctttacttgatctctaagccatctcactggtcaaaaacctgaactttttgtagttcttttatttatttttgagacaggttctctctacacagtctggctgtccagaaagtaactgtagaccagagagctgcctgcctctgtctcgtgagtgtaaagggtgtgtgtcaccacaccaggctgtagtgctttcccagaaaaccctccagtactgtttctcacttgagtcttactaaccttttgaaatagaatttgctttgattctggtggtgttgcaagttttattattagcactatatgtgctaatatataatacaaatagcacaactatttgtatcactggaattggaatatcatacattagaacaccaacttaggttttagattattagcctcaaaattgaaattggtttcaggatagtaaaaatggttctgtataaggaacttgggctaggatcttcctctgtatgatttaactactcagaccctgtctcactggcatgatgagagtttcagttaagagttgttaggagtaagcctttgaaaggactcatggagtaccattcctgggtaaaccttttacagctcccacttaactgggtaagtcattcatgttgtacacagcatttatcccaaacttcattcttcctgaggccatcaaattggaatatttggtgggcttttgggcagggtaataggggcattataagatcttcgttgaactgggcagtatggttttccattcctttacaggcagatttgggagttcgaggccaacctgttgtacagagcaagttctaggccagggtggtggtggcgcaacctttggtccaagcacttggaaggcagaggcaggcagatctctgtgagttcgagaccagcctggtctacaagagctagttccaggacagcctccaaagccacagagaaaccctgtttcgaacacctcctctcccccacccccaccaaacaaaagaaaaaagacttaagcttctactatggttggatgtgatgttttaacaatattgaatcactctgtttcaagaatattgaagcctgggggtggtgccacacacttttaatcctagcactaaggaggcagaggcagggtgaactcttgagttagaggccagccagatatacatagtgatactctgtctcaaagcaaacaaaaaccaaaaagttgaaaggaaaagataatcatgaacccaagtaatggtgtctttaagagccattgcagctcctctggggatatcatcggaatttctcagtgcccatttctaagtcggttcactcactggctttgtaacctgtttggtgactactcagcttctcttttattttctctgaaactccatttccccatggttttccttattcaatctctggcttaaatttcctttatattgatgtgctccccagtttgctggctggtgccacttgctcatgacagctgattgctcgtttgtctctcatctgcttagcattgacctggtggccttgctccagaagcctgtccctcccactcaagccgcagaagccaactcctttgaaacatcccagcagcagggctttggccaagcacttgtcttcacaaattctcaacacagcaatcagacggcacaagggtctggcagctccacttctgccaactcctattctcctcagagactggtaactcacttttatttcaagttggggtcttcaggaatgtgcccattagccacagtcatgaagaatgtatggctcttaccttgcagttatttcctcatgtaaaatgctggcagtagatctttgtccaggaaacaatgatgtgatggtttccaagcacatatctgatgattccgtgtagagctgagctactgagtttcctgggccaagatcagaactcctttatgagtcctggtcagtgagtgataactgggatgaaggtatccttagtaatgattttgttttttaaagattttatttattattatgtatacaacattctgcttccatgtatatttgcacaccagaagagggcaccagatggttgtgagccaccatgtggttgctgggaattgaactcaggaaccctggaaagccagtccgtgctcttaacctctgagccatttctccagcaccttagtaatgatttttaaacttcctgtttgttgtgggtgtgcctgcaggtatgcctgcacaccatgacccacttcaagaggtcagagacaacttgtaaaagtcagttctcactctccactctgtgggccatcttgtcagcccaactgattattttcccctggttttgtttgaaaatatgtttctgtatttagtatgttttaaaatttttgtttgcaaattgaataaaaagcagatgtttgtcttgtctgtccaggtgttcctactttgcacttttcttctattccataaaatatactcctttttcagctggacgttggtggtgcatgcctttagtcccagcacttgggaggcagaggcaggcagatctctgtgagttcgagaccagccaggtctacaagagctagttccaggacagcctccaaagccacagagaaaccctgtcttgaaaaacaaaaacaaacaaacaaaaattacactcctttttcttaaattgtcaagtattatatgacagagtccctttcgatatgttttccttgaaataatgtcacccgctgttaggcaggcacagtgactgttacttctgagtgccttcacagtgagttcccatcaggaagaattctgggattggtagtgaataagactgacaggtggggcaacaagcttggagtgtcaccagtgaaggaatttagtacaggaagacagctgaagtctgttgtaatgcaaagtaaatacagagaatctgccagtgtgctttcctctgcttttccatttgctaatgacatatttctgacatctatagtttctgtttggtcacggaggtcacagatgaagctggaccacactttagtgagagcaagttagtattaaattagggttgtggctctaaacgttactactatttataacccctggtgaaattaagtaacaatttaacaataataatatagtaaaaatgggttaacataagacagaatgaatcagaatctgtggtattattaggacttggactctgtacatatgctcatttgtgtcttactggttcagttaagtaggtgaaattgaaactatactaagtgttacagagagcaaatcagtggctgttgagaaaaagagtatttggtaatagtagctgctgggtggatggtggatgctgtgtcagtgagactagtgcttgagaaagatgggtttgagtggggcctcgatggcaaagtaacatttgcacaaatgcactaagaggtcagactgtgaaagatgggcctcagcagcccatgacctagtgtgttttgctcacagtggagagctctgaattttctaactaagctattccacatcttagaatactgataatagccaggcatgatggtgcacaccttttaatcccagtaccagagaggcagaggcagtcagtgagtttgaggacagcctggtctatagagagaattccaggacagccagggctacacagaggaaccctgtcacaaaaccaaagaatattgataataaaccaaagaatattgataatatccatcccctctggaggaggggatcattagtttttttgtttttttgtttttttgttttttttgttttttttttttggtttgtttttggttttttttgttgttgttgttgttgttttctttccctttcttgtggagaatgattggtgttcctagtcatctgaacaacctgagcacagtactgttggcatttactctgcttcctgcgtgtctcagtgtctgttattaactatgagcttttgatgtctacttcaatttaatgtttcaggaagcactcagcactgacctctgctgttcctgtcattagagataattactgtttgcagtttaggaaaagtttgtgttttggtctatcaagcatatttttgtcattagttgtttgtttcttaaaagtttattttatggttggagagaaggcccagcagataaaagcagttactgctcttgcagaggatccaagtttgattcccagcacccatgaattaaaaataataaattagtactaataaataaaataattatttttttaagaagactgtaataaatgcttttgtcctcttaacctcacatcaggaccagggaggaatgctgcatagtctagtactgttttttaaagcaaggtttgcttgttcagatgatccaagatgcagtgttcttacttctgaagaccactgtgtttgcaagcctgaagggaaagaaagctaagagcttgtgctgtttctgtgtctttacagtcatctgtcctgggctcagggtttggagaattggccccatcaaagatggtgaatatctccagctcccagattttggacaagttgaaagcaccaagtttgaattcgtttgctgccacttcaactgcaccgcagagcagtacaagtccaccagccactactgcttcttgggatctaaagccctcagcatcccagtcctcggtcctcaatcattttggtaagtatatgttttctgagctggtttattgtactgagtcagttagcagggcatgttttatgtgaacagtatggtggaacaactaaattaattgtctcattgtacagtgcctccatttgtttattgtacacaattcacaggaatatatagcttcctagctagaagagaagagcaaaaatgctgcatggtaattaatgcctggaattccaacacccaggagttggagggaggaggatcaccataagcttgagaccaacttagtatagagtaagaacctgttgcaaaagccaagcaacagcctctttgggctggcttgttacatgcctttgatcatcatcagtttgagcccagttgctctgcatttcaggactatactttcaaaaaaaaaaatgtcatgcccccccccaacaaaaacaacaacaacaacaacaacaaaaaaacagctggaaaaccaagcaattgggactagagaagtgaattatcgagtcctggttgatctttcagaggacctagcttggaacccaccatccacatgaccacaaaaccttatgtagctccagtttcaggtattctggtgcctttttctaaccttcatgggtacatccacatgatacacagatatgcttgtaggtaaacacctatgcacataaaaagtgtaattactgggttggagagatggctcagaggttaagagcactgactcctcttcataggacccgagttcaatttccaacacctacatggtagctcacaaccatctgtaatgaggtctggtgccctcttctggcatgcaagcatacattcagatagaacattgaataaataataaataaataaataaaacctttaaaaacaagtataataaattaagcaagtagttgctcaaatgaaaagacaaaaggtaagtgaatgcatggtaggggaatctaagtggtagtttgcaactcttaaatacagacatagatagcacttttgagttcttaatgtggaaagtcagtgaaatcactttctcagggttttggggtgcagctcagaagtagagtgtttggctgctgagtgaagccctgggttttaaccacacactacaaaggaaaagaaagtccacaagagctatgatgcacccccattctgccattttgctgtatccatcatgatttggtcaagctttatttttccattgtaaagggagcatgcatatacttgatgttttagtcctgtttcccagctatactcctgtgaatgcttgtgtgagggaatagtccgggttggtagaggggggatttttacatggttgcttttatgcttatcatcatcaataggcagaattctctgcttcctgaaatgacttgccatgctcaaagtaatctttgtgaaggctattaattacttcaactctattggaagctggattcataggcactctgcctgacagagagcattaattacagatttgctgaaagaaaacagatgttgagcatgaaccagggtgtttgtatagacattctaaacacaacaggcactcttattagttcatgtgttgacacttggtgcctaccatatagaaacattgatgttgaatctaaccaacattcaaacacactattcagataatagatataagcttctgctgttagcgtcctcccataatttataagtaagtttatgaataaaagtaggttgtttccatgttctctgtgaagcctgtgttttttgctacctgtctcattgtaattgaacatgaacttacttaaataagatgtgctgtttttattttattattttaaacagtgctatgttgcccaggctggcttttaacttaacaatactcctgccttggcctctgttcttatgagattacaggcatgcatcctaacactcaggtacttggcatttctttactgttttctttttttgtttttcttttttttgttttgttttgtttttgttgtcaccccccccagggtttctttgtgtaaccctggctgttttggaacttgctctgtagaccaggctgtcctctaactcagaggtccacctgcctctgcctcccacatgctgggattaaaggtgtgcaccaccaccaccaccaccaccaccgccacctcctagcagtttgcatttcatttctatgatttctgtttcctgaaattagaagtgttttttgtgttttttgttttgttttttatttttatttttttaattacaattggaggtggacagtggtggttcatgcctttaatcttagcacttctgaggcagaggcaggcagataatttgaattcaaggccagcctggcctacaaagtgacttccaagacagcgaaggcagcacagagaaactgtgtctcaccaaaaaaaaaaaaaaaggtagaaagaaagaaagattgcaattggcatgttctaatagttgattttattgtatggagaaaagagtcgtgtgttcattcattaccatcttgtttttcatagctcatccatataatacgagtatgaaaaaatagactgtatatgctgagttcagtgccctaaaggtgagggaagatgctgtgtgtacattaaaatggagcagcctatgaaaagaaaatgaagatatataaattatgtctgtgtggttttgatagtcaagaacccaggtacaaagttgcttctctagagcaaaaatgagaacagcaatggaaagagttgtgtttgtcacacatgttccttatagttttatattacacataatatatagtaatcaaaatagtttttttagaggcatgtaccaaatcgatggctgtggagatggctcaatttgtaaatgcccactgtgtaaggaggaacatctgtctgtggctgttcacccacatcaacattgggtgcaatggcacacatctgtgatcctagcactgaggaggcctacagtttaattctggagctcactgcctcgatgaatgatgagttcctccaggtccagtgagagaccttgtctcaacaaaaaaaggtagaaaggcactctgggaagcaattagtgatgacccctgcctacacacagagaatacagaaaaattgaaaatataataagcatctacaataacaaacaggtgtgtgtaatacttccatagatatttctacttcatgtcccctcttcatgaaaaataaggaacaaactattcaggcaccaagtgtgtatttgttttcctgttcttccagcaccatactatttactcttttcaagtagatggttcagaacctagtagtaatagaagcctcctgaaactaaaggtatagaagtccaggtgtgttgcagaattactcattgccgcttaacttttccttccacatttcatagacttcaaatctcagcccgagccatccccagttcttagccagttgagccagcgacagcaacatcagaccccggcagtcagtgttcctcctcctggtttggagtcctttgcttcccaggcaaaacaccgagagtcaacacctggagatggtccttctgtcaacagacttttgcagcttcccaacatggctgttgaaaatattgtatctgcccaccaaccacagcccaaacacatgaaactccctaagcgccggatacctccagcatctaaggtaagcattccatgatgaattccatgccaaagggtttatttcacactaacgcaagtatcagaaaactgagtattagacattgggatacagtgccttcaaccatagctcatcatcatcgcttgggaggatttggccatttttcaggcactaggctaattattagagagagtgcagtcaggccgggagacagagcctcttagttcaagtacagacctgagggtctaattgaaaggaagcacttttgttattgtgttggtatctcacagtttggaggtgtgtgattacctgactagataataccttcatcactgctgtgtccctgaaaatagctgaatgtcctcatctactagctaccgttacatcccccaacaactctaaagctacttaatttataatattaacatggaccattcctctacaaaccaataagttgtttgctcgctttccctcactatttaaaaggttctgtttctccccctccctcccctttcccactgtttttgccattgcagcccatggaagccacttgcttgagcctgttgtaagccttaaggcctggagccctggcctctcttcctaacagctttgctttactaggttcccgcttccgcagtggaaatgcctggttctgcagatgtcacagggttaaatgttcagtttggagcactggaatttggatcagaaccatctctttctgattttggatcaacaacttcagccagtgaaaaaaataatcagatgcctatcagcttgtacccgaagtctttaaggtacaaacctcacattttagtttgacaggatatagtcctttctttgcaaagtaaaacaaaacagagtgtaagaaattggtgaagacaatctaataaaggttttgtgcagctctcaacatgtttagcttcacaaactctgctatgcactcctttttcttgctccttccctctgacaaagtgtgtgtcagaactgtctgatcaacatatgtcatgcaagctgaatcctgcaaaatgtggcttttgtatcccttagctttcatttaagctttcagaggtcatccatcatggcttctattgccatccatttcactgagcaaatgtggccgggtcatagttggtagacatataggctttttttctctctttatgggtggtgaatggtattgccgtgttacaatgtttcttgtagcccgataactgagttgtgtgataagcacctggctgtggtcgtactttacactcccccaggagtctacaaggacctagcttctgcacagctttccaacacttcagtgaaaccttttgcaagtagaaagatttgagatttttattagtaggtttttccatgtctagagggaaaacctgttaaattatagactgtagtgcagctttgtagttaatgtgatactgagctggcctggttagtgaagctgtcatatgccagtgtgtgcctaactaacatagtgtactctttccagtgaccctttgaatgcctctttaccaatgaccagtgctgtacagaactccacctacacaacttcagtcattacctcctccagtctgaccagctcgtccttgagctccactagtccagtaacaacgtcttcctcttatgaccagagttctgtacataccaggattgcataccaaagctctgctaacccaccggattcagctccaggctctgttgctgtaagtggttctcctgggtttcttttcttaggatgcacactttagccaattacactttaaaattaatttattagtcaggcaaacacctttaatcccagcattatgaggtagaggcaggtggatctctgaattcaaggccagcctagtctacagagtaggttccaggacagccatgactaaagagaaactatgtctccaaaatgtgatgggggaggggtggtaagacgtcaagagacaacttgtaggagttctctatctagtgttgagaggatctaacactgggtgtcagacttggcatctggtgtctttgctcatagagccatgttgcttgtccatcatagtgtttgagggaaaggaccttgcttttattaaagcaatgaatcaatgaatagtacttttctaccccactgtcacattctaaagtgacattaactacaaagctgcatgtatatagtttttgtttttgtcttttcttttcttttctttttttttttttttttttttttttttttgtgtgtgtgtgtgtgtgtgtgtgtgtgtgtgtgtgtgtgtgacaggatttctttgtgtaactgccctagctggtctggaactagctctgtaggcccctcccgccttagtctcatagagatccacctgcctctgcccctgctggggttaaaggtgttcaccaccacccggccagcctctagtaccagatgtacactaccagaagtgttgcctgtggaacactcatcaaatctaatcagaaaagcattggttattctcataagaggcttatcgttgttaaccagtgggttcttctagtctggattgttgtattcaaggtccatagctaagtaagacttgttttaggggccttggggaccctcctggccaagaactgtaggatagggtatccagcttccaggactggggtttttgtttactaagctattgcttctaagaatagcttgatgcatgagtactggaaatctccattcaaaaaaactgaagcatcattctattaagaatttgagggggactggagggatggctcagggcttagcactgactgttcttccagaggtcctgagttcaattcccagcaaccacatggtggctcacaaccatctgtaatgggatctggtgccctcttctggcaagcactgtatacatgataaataaataaatctttaaaaaaaaaagaatttgagagaaaaacaccagggcaaagcaaggtctagatcttggcagttgctggtcagcagatagagaagaatgagggagaggttggcaagcagctgtggataggaatctctagagaagtggtatgaagcccagcatgtctcaagctggctgtgatgggtctccccagaactgcaatgatagcctgtgagccaccatgtggatgctggccatcaaatacagactccctggaagagcagccagccccctttctgctgtgtcatcattctagtcctagttggacattttaatatagagtgcatcagcttttccctgttgttactttattctggagatggtgtcttagcctcgtgggctctgcttttgagtgcacattctgtggcttcctccccagcctgtgagggcaggtgccattttattgttttagtcagtcccaccacagtgtcttaggtggagtcaagccagttgacttaggttctacaatttgtggagagcatagtcacaacccactctgtcttaaggtcacagctcatcttttcttagaaatagtcctcaatgtgatgcttcctggtatggaagttactctttctttaaaaaggaggttgactttttttttttttaatttagaaacttacctttgcattacagaatttacatgtgaaatgggaagcctcacatgacttaattataatgagacttcatcttccttattcagtttaacaacctgatagctgttttagaagtggtttatcctcctgtgtctttgttacttccctgaattctgaatctgttttcaaaatgcccacttcttgcgatttattaaagttagttgtattttgtcttctttttattttcattttccttttatattagaaaaggaatgaaacagatacgggatggagatgttcggttgtaagagcctgtcctgctcttgcagccacctccggcacatgacacccacctggtacctgagtgacgtgcactcacatagatgatgcacatacacatgagtaaagtctttgaaaagaaataattctcctttgttaacctgtgcatatgggtgttatagtcccaattcagagttaccctggtgattgtctggaaatgtccatgtgttaactctctctctgttctttgtagaatggacatggtggtggccgaagtcagcatacagtagacagtaagtgttatattttcattacaactggtgaaaaccaactggggaaagagtggctaacataattcagaaaacaccaattgagcagtggttaattctccaaaatcagtacttgaccttttccctggaaacccctttttgtttgtttttgagattgtctcactagtagctctgattgacctagcttggcttgctatgtagaccatgctggcctcaaactcacaatacctttgcttgcctctgcttcctgagttcctgaattaaagatgtataccaccataccacacctcagagctactttttctgagggggtgttttagtcactgtgtatcccaggctgactttccagttactaagatgtgaagttatctggggatctcagtgtgcatgtaggaagctaccgtcttgagccattctcactctcccttcctgctccttttctaagggaacattctctgggagtcttttgtgaagtcacccttaggctgtggaagtgacctatatatagcatcttaatttggggtgagatgcttcaccagagtcttcatccagtttctttcagaaccaacttcattttcagaatcagacactagctgggtgttggtgacgcacatctttaatccagagcttgggaggcagagaaaggccggcagatctctgtgagttcgaggccagcctggtgtagagagcgagtactaggacaggctcccagagctacacagagaaaccctgtcttggggaaaaaaaaaacagaaccagactttaaaagtcttaggagtgtgaattcactgcaaacccacctcccccaaccctatcctttagtttcctagcaattatgcaaggattggcaccattcctctcctaatttccctatgtaacacaaggtatttcactccaaactggttgtcctttttgattttcaagtcagggtttctctgtgtagccctggctgtcctggaacccagagagccttgcctctgcctcccaagtgccaagactaaagttgtgtgccaccactgcctgacaaacccataaccacagtcctcttacaaaaccaaaacaaacaaaaaagactcaaaaagaaaaaacaaaaactacaccccattattaattctattccacacttacatattactcaaagataacctaatcatctttttcactatcctatcatatcatattagaggctgaaatggcttcaactagacccaactgggaaaaattaaagcctactcctccatttcccacacagagtgctgctcttccatacaatccaactcatactccttagcccaataattaatatcctaacaacttcagtattccctttgtttttactcattgatattacttccctctcacaaatatgaattaaaatacccattacactatttatagcctctacagtcctatgtctaatttatgtccccacactcactatcgttctagcaaccaacagtaaaatatttaatattagcttggtcaatagactacctccctagcctatatatagctctgagttcagtctctaggaccacatgcaatcaggagtgctggaaggcatgagaatcaaaaggtcatcagtgtggtggtatgtgtgaatgcttcaattccagcattcaagaggtggtggcagaaggattaggagttcaaggttggcctgtgctacatgagtctctgtctcagaaagaaaccaagttggccaagctgcaggccagcctgccccctgcccactgtcaactcttcttgttagagtggagtgcttcctctcagggagctctgcaggagggaagagacgatgatgtgtttccaagcacatatctgacttatgtgcggatgacaatcaagctgagtcttttccacggtcatcagttttatctgtgacatctctgacacaaagacttgtatctgtgctctgtgattaactttttgaaacatataccaaggaagtttccgctgtgcatctgcaagcagatgttggtgtgaattcttactgcagttcatgaacagatttccacatttcccctgaagttccagtgcactctggcagcctggacctttactggcttcaagtggatggaaatgctctgaggaggtctttcttctctctcagctcttccctccctcaagctgtgctttgtaagggatatttgtctcactacatacacgtctgctttggcccgtcttgtcttttctgggtgctggtgccacgtgtcagaaaatgggagaaatatgtccacatcatgacagtttgtttgggtgtcacacgtggttatatagtcctgtctgcaagaagtggagctgcctggtgacatgcttaggctctatcctaggaaaatgttacatgtcatatagcatatctgaatgtgaccagataccgaatatgtctccagtaccaagggttgcttctgaggctaaagagatatgtttcttgcagctacttcatctgttccagctccaaagacgacagatcctccagccctcccatctgtgggctccctacccaacaccacctcctgcactgcacttctgccctcttcatcccagcacactgccactttgccctccttgtcccagtctggtgacctgtccagcaatgccctttctcagcttagcaggtacgtgggtgacagtgagaataagaaaggggatggagacttgtagggctcctatcagatgagaagtgtcatatagactttggttgtgctacacttgtttagactttggcctggtcacatcccagcatcagtagatacgaaaatcctaactgcgtctaatgtttctgctgcagagcctgaggtctgctgagaagcagtgagaacataagcagatacttaaggacttgcttgtccttagtttttgccctgtaccacttgaatgtgtgtctgccttaacgtctgtcctgattccagagatagactactgggataggataaaggaaagggagttagcttgttccccatgcttcctggtagaactcagaacaaacgtggttggttgatttgaactctggatctgatgagaatttaagctggactcttaggtgtgggctaaatagaaactctcttgactctcagtcttctgagctctccagctatgcaatcctggttttattctttttatagccaaaatggttataacttgttgaagccaggatgtatcagatgtcatggtgtatggccctgtagaccatttttgaccaacaggatgactttgtcacatgattctaggggcatcgtcagtgattggattgaccttgattatagcctgttaaaccaggtaagtcagacttccaggaacaaacttgctgacatgtggtactcctttttatcttctagttctctctccagccaccagaacagcttgtcctctccacatacagcgcgccccacaagcacgccccacactgtaagtgcccacacttcctgcactgtatacccagatctcccatgagttggttaattttgatctgagatgacccagagtctcctggttcattgccttagaccttgtgtgctttttcctcacacagatgtcggggctgtgcttgcttcaaggacttagggtgctcttttccctgcagggacagttttgtttcttgccctttttttatttcacaattttttgttgttgttgttattgaagaataggtttgtttctgtttcccgggtctcactgtcctgccttgtggcctaaaaaaaagatacaactaaattgcattcttttgtgttgatgtcattaggactttactaatggtggtgattaggtgtccactttgattgaccttcataccaaattgcctgctaagagacagtgtgagaaaagatgtttttagaaggtcaagaaatctaggctagtggagattcaaagtggagatgtcagcccacatttatgttcactcacatttatggatgtgcactgtgtttttccctgttgcccacacaagtcaggaagagggtttcagatattctcgctttatagctatgcatgattttgagataccaggtgtgtgctagggaccaaatctaggtcctctgcaagcttttaattactgaaccaccatctaaagttcctttcttcttatttatgtatgtgcaactgtttgtgtctgtgtctgtgtgtgactgcaggaaccatagagtctaggaaagggtgttggatcccctggagttgacatgacagttggttgtgggccctctgatatgggtgctgtgtagtggtagtgggatattggcagagacactccccctctagaagagctatgtgcgctcttaaccactggggtttctgtttgagacagtccatggaactcccaaagatccccttgcttctgtctctgaagatgtgtgttatcatgaccagcctccagcccagctttagtagtctggacggtaagtcatggtggctgaatctggccgtacagctagaggctgcactgaccctaagacagggcatctcactcatcttacagccgctgagcaatggcatggctcactgcctggtgagctgtaggagttctttctagctgtcccagctccgtctttcttgctatcaaatccacatgtattggcttttgttttgccagcatgccagtgtggagagcaccccatcctcagccaccttctcaacagctgcaacctctgccccaagtgccccatccacgggggtcgtcttgcctgggagcagtctgtgtctgggtgggaccacagtgagtgtgcccagcaacagtacccgggccacagcgttggtgacctcaggtatgtgcgccaagtcccttacctatctcctcaacgtaaacttccagacctgttccagacctgtacctccacctccacctccacctccacctccacctccacctccacctccaagcagctgagctgcctcacagtgaagtgggtaatctcttgtgtttggtttttcctctttataggcaaagcacccccaaacctgcctcagggggtgcctcctctgctacataatcagtacctcgtgggccctggaggactgcttcctgcttacccggtgagcacatagtagaactcctgattgcctcagggcctgatacattgcaggacttggtaaggggttgtgagttaggacagggctgcccacctgaggcagctcatctccctgtctctgtccacctaatacccaatgtgtcttcctccttctagactctatgtagacatgatctgtagcgcctgacccaagtcccattcctcagtgtgtctgctttggtgtgtgtggtctctaatgtatctgtgactctcctgaagatctatggatatgatgagctttggtgtgtgtggtctctaatgtacctgtgactctcctgcagatctatggatatgatgagctccagatgctgcagtcgaggctgccaatggtgagtacaaaatggcagcccagactctcagctctgctccttaacctgctcgactgccaccacagttggccttctggaccccagctatgggactctcccacactaccactgagaagctgtgtctggtggtgatatgcatggtttgacctgggggaggggaggcagacatatagggagcagtgctcatccccaggagaatttgagagactttagaccacgagcacatgtgaaccatgtcctgtaccaaatgtagtcccttattttcctgctccttttttttatattttcttcttttttaagaaaactaaaaatagctgaacatggaggtccgttcctgtaatcccagcatttgagaggctaaacttgagttagaccaacttaggctatatgttgagatcctgtctcagaagaaacaactatcacacagtcatgagagttgtacttggaaatataatgcagtcttcatctcagggcactggtgtttctttgggctgtagtggccaatggctgccctcatgactgctctcatgctcttctctctgtaggagaatgaggggcggggcttgactgactttattaaactgtcatatgggtttagcctttcacctttatttagaagaacgctgtccctggtgtcattgccttactttcagccagggttgtctgttctgaccctgagtctagggataaaatgatgggtcttataggagagccagtgttgagcagagaaccggagtggcccactcctcatgaagcaggattaccctctggttagccagtctcagcctggtgttttgtagagcatcagtcagtgacagacacagaatgtagacctcaacccaagcatggggctgcctgttcttcctccaggctcactccttctctacacacacccctgtcacatggttgctggccaggccacccagagtgaacagctggagggtcatctcctctccatctgttgaagtccttttcagagccagaggctgcctgaggacctgctgctgggtctaataggacttggaagaagttcctgggtagaatccaagtgtggcctgatgacactcaacagatggctttatcctgtgttaggtgttcttcttggctctccacgcacacccatgggtctccattttttaatttcctgtgtatgcgtgtttcgcctgcatgtatgtaggtgcaccatatatgtgcctggtgcccatagggtggaagaggacatcagatctctggaactggtggcagttgtgaactgccatgtgggttactgcaaaagcagccagttctcttaacctttgagccatctctccagccctttttctttttaaaagttttgtcttagaggacatctgcagtgagctcacagtagaaacagctttaaatttttccttggagcatattccagcctttcttggatttccttgttttatgtgaaagggtactcccttctgggtttcctccccccagtctccatttgggtttctgcaagctctttgcagttttctgtgcctcttggaattctggctgagaattccatgttttcctggtgtttaccaagacttgcagccaaagggttccagtgccactcccagctgagatgctcctgtctggcttggactcagaactagggcagctcagaatcctgggtagtaggggccagggcaggatttcgacctctataaagtataacccctttttactttttgtagctctgtgcagtgtcattgttgccagggctaaatgaattgggagagactaggctagttaggacctagacctgaggtcctgtacctggctctgcttcctgccccttctacgtttccagtggctcttcacttagtctcacagtagagagcagtcaagttggtttgatctgtactgtttaccaagtctccatatgtgttgtaaagataggtgtgagattggctctgtctgatgcaagcattaagatttgcagtctgtccataccttgtcagttgaaacgggggctctgagttgcacaccgagggtattgtcacattggagctctctggtacagctgcccaccatggtcacacagagtgtggcatcacccggagtgcccatgcttgttctgccagctgggtctgctctctgtgagggtgggacagatgatttgctcagtgaatctccttggtcttttctaggattactatggaattccctttgcagcacccacagcccttgccagccgagatgggagtttagctaataatccgtattcaggttagtttgctcagtgggcaagagtgggaagagatgggctggcctggagctagcaattggaggccagaaaggctgaggtgcttgaaggtatgagtcctgagctggcagttcctgttcgtgtttgtaacagccatcctggttcttctaggtgataccacaaagtttggccgaggagactctgcatcccctgcacctccaacgacaccagctcaggcacagcagagccaatctcagacccaccacacggcacagcagccctttttgaatcctgctctgccacctggctacagctatactggcctcccctattacacaggcgtgcccagtgccttccagtatgggcccactatgtttgtgagtatttctgcagggtgctccctgggctgtggcttcctcaaaggttgaaaccctggacatattttccagcgtctgtcagttacatctggccttcaggattgctcaggggtcagagtccattccccagctgccttcagatccctaatggattgcattcatgaaaagactgattctcttggttgtgacttggttttgtctgaggctgcctgatctcctctttgccttattctgacacactcaaacctcacctgcttgtcccactaggtcccgccaacctcggccaagcagcatggtgtgaccctcaacacaccccctaccccttttcagcaggccagtggctatgggcaacacacttacagcacaggtaagggcataccccctgcactgaggggcacagggtaggacagacttgcttagccaacacatgcctctttcttgtaccctgccatgctaggttatgatgatttgacccaggggacagcggcaggagactacaccaagggtggctatggtggatcatcacaggcaccaaacaagtcagctggatctgggcctggcaaaggtagtgtcaggtcctcacctgtaatagttgtctcctatctgactctgaggcagggctaccctgccagtctttggaactggcactgaatgctgtggggaacaactgttttttgtcctaggagtatcagtgtcttcaggcaccactggcctaccggatatgactggttctgtctataacaagacacaggtgagggtatacaaaggtgggcaggtagttggggagtggggagacatcagttcagcctggccttctcattgtcatctttgccctacagacgtttgacaagcagggatttcacgcagggacacccccacctttcagcctgccctctgccttgggctccactgggcccctggcccctggagcagcccctggttatgcgcccgcaccgttcctgcatctcatgcctgcccaccagcagccccacgcccagctgctacaccaccaccttccacaggacagcccggtgagcgcagggatggaggcagcctgcctgccctgggcctggggttgtgtgctacccattatagccttttctcctcttcctcctcagagtggctctgctcagcgcaaccagcccagctccctgcagcccaagactcaagcctccaaacccacctatggcaactctccgtactggacaaactagaccctgaaaacaagagggtgggctcttgtgcaggagagaacacgtggagcacatttctgggagcccggtgccctttcctagaattctgagacataactgtcagctgagcctctgtgggaagcctgcctcccagacccactgttgtatgtaatgtatttatgtatgtatttgtaaatgtgatagaagcctggagggactggggtgtggctactgggcagcatacaagtgtgctgtccccatctggacatcctcactgtagccaagtccacccctcccccccccttctgcctctaggccttccacgtggctcccagctcaggagctgtctggtgtgccactaaagggatggtggtttggggactggggtcaggtaccaatgaagaatcacgacttttctttatctcgctccctgtgaaatattgtttcttccttctgtaattacttcatacttgttgagaaactgatccttttgtcatttgtcatggtcccccttctaacaaatcttcagctgggaatagcagagatgatgcctgcacagcagggccttctgcttttggtctggtcctgccctaggggcttgcctttgaccaaccatttaaagaagaatctgaactgggtctcagagatgttcagcccgtcagctcccttagaaagaaatcaaagatctgcttccatctcagtgaaagcctgtctccaaacaaaggctcctctataccagttgtcccaaaccaggtgggcaactgcttcagggttttctctcacccaaactccacctaataaagttcttgagagca

SEQ ID NO: 6 - DNA, 51421 bp, Cricetulus griseus
  misc_feature (32411)..(32421): n is a, c, g, or t
ttaatgtgttaagagccattgacatttgaagatcatcagaagtgaagataaaagatctcaaaaattataatgtaagtgaatgggaaactacaaaaattggacagaaattaatattgccaataataacctttggaatcctatattaccccaaatgaaatttgttcatatgagtaatcagtaacttcaaacgttagtgccatgttccagtccagaacatccttttgtctggggaaagcagtcattaagttttagtcacccagtaattttccattggggtatgcgggtgcctctgtgtacttcctcccttttcttctctaggactttgaagtttgatgtgagaacaggatgaatagggaacaaattatatttatgtggagagtttgttttctggcagcagatacatacatacagatacatagataaccattttgtgtgtcttagtcataaagagtaagctgtttcctcccttcccaccttctcctttcatcccttcatttctctctgatctgttgagtattcactatgtctgtttatgatatgggctagatcctacatttttcccctcctgagacagggcttaatgtagcccagcctggcttcaaactcactttgcagcttagtgtggacatgacttctgatcctcttgcttctttctaccactcgagtacgaggactacagaagattgttgcacttgagtttggaaattcttcagaccaaactgtgggctttttaaatgccaggcaagctctctaccaattagtttccttaattcttgatagcttggtgctatgacagctatattactgttaggtacatcaggaccactcagtgcttttcagatgctctggagacctgcacattctagttcaggtggtgtttggtgaacatgtggtttgcagtttctagccattctgaaacacagggaacagatccaagaatctgtactgaatgaagtctgagaaccatcagttcagatgctttttggagtcctagtccaactccaagagtttgaagatgagggaaaggcattgggaagtttatttatccaaagacacagttaatttttggaggctgggaaaagttaagtgttttttctttgaagccttcacaggtcatgttgtatgttttgtttggctagacagccttgctatgcttagtgtttataagcccttcctccatctcacatactagtatcataaccagtccaccattgtacctggaaaaacctagaagcctgaagatcacagtttctgagtctttagccagatgtatggctgattgtgactttgaaataatcattgggtaatagtttgggtggagaaagagcactttttttgtaggtcagactttcatagtcttgtctggattgaggttctatgcttctgacgatctgacttcttttcgtagagtctgtaagtgggaagtatgggctagctgtgttgtgagcagctctgttcattgtttttctccccttgggctctgtgaagcacagtgttaggagttgttgagttaactgtttatggagccacagatacagccattgatattaactcatatttgtaatattttgtaacagtatatttgtaatactttggtatttattgaaaactctaaggaatattttgaaccatatgttttgacttaattttattactttacatattttatatcgtgtcttatagttcttgagttgtaccttgtattcatagatgaagtttacccagttaaaaaaaaataccctgttatgttggaaacatgaaaaagttggattatataatgttactactcagtttctgagtgttttgatatatgtcttaaaggatgcttttcagatgttaataatttgcttttgtgatgtgggaaccaagctgaagcttgaagttgctcaaagtgcttcttgtaagttgttgttcacctctgcacacatattatcattggcttcatagatcccaattcattatcattggttttgtaaactataggctcaaatttgcaaatagatcatctctcaaagggaacttagtctgggagtatagctcattggtaaaaccaatgttaggcattcccaggttcagtccccagcatcataaaggaaaaagaaagaaaaatgggactttattatgtaatgttaattcccttccaaagacatttacttaagtaatttcatacatgcagaaagatacttcagaatgacactatatttctaggataacctgggaaatgtttgaaaaactagaatgtcatagttttaatgtaactgctacctatggagttgccttgttaattatagatgtttgccattgatttagtttaaaatcagaatgaaaaatgtatacattgatcagttgaacctgtttcttacttcttgtgctcagattttgttaagtatttaagtatgtgttattaaagtaatctttacacaagtacctaaatttctctttcattgtgtaagagtctgtgatggttaatgtcacttggtaagatctaaaatcccctgagaaatgggtacctgacatgcctgtggggagttatcttgattttgttattccatgtgggaagacccatttaaatagaggttgggaccattgtctgagcaggggagccttgtctacaaaatggagaaagtgagctgcgctctagtgcattcatctctgcttcttgactctggatgtgagtaaccagcctattgctgggactgtgcagccttgatggacatgtccctgagctgtgacttcttcaagtcgcttttgtcaggcctcttctgacagcaacagaagacactgaagcagaatcttactgataagttcaggttgtcaccttcactacttcaaatactcaacagtactatattggaagacttcttccagcaaatcttcatgaaagaaaatgattagcaaataaataaatgaatattcactcatctattcagtgtaatcacagaagctaataagcatgcaatttgtattttatggtttctcaggagagcccttattatcatgatagatacagactcagaattttccagtgtccctgctaataaaagatggaactggaatttggattttcgtataagtgtgctgttgattttttactcccaatataaattatagcgtggaagtggtaaaaagttcttgggatgtacattttgctgattaaaggaaatttcttctgttggaaagttgatgataggctcatcttgtccagtcagttccattaaagtctaactacaaagatctcatttcacctaatccttctctttctctgtattcatttaaaactacttcaaaaacataaaaaagacattcctcagtcctgtcataaaaataaagagaaaatgaaaaaagctagaagtaatgactctatggcctgttatttgtggcaaccaaccagaaatgtaagtatgtagggaaccgtgttcaaaagtatggatgcacaccattgtcgtgtaggaatccatgaatggtaactcaggtatcaactagtccaggctaggaagaggatggagaatgggttgtgttttcttagtgctttggcttagtgataggaaatgagcagtaaaacccaattccacttcctcatcgtcacccagactttgaagtctgtgtggaaagttaagttaattggaaggactgtgatttgtgcagtaatagtagcgtttgtcctgggaaaggacctgcttagtttaaggcatgacacccattcatttaacagtgaattcacatatgcaagtagcatgagaagattatacaaaagtcatttattaagacacagatgggggctggtgagatggctcaggtaagagcacttgttgctcttgcagaggactcaggttcagttgtcagcacctatatggcagtttacaaccattgtaactctggttccaggagatccaaaaccttctgacctctgcaggcactaggcatgcatatggtgtacagacacacatgcaggtaaaacattcacacaaaataaacaactgtaagaatagtcttagtgggtatgtgttgttctgtgcttgccgagatcagagtgttgcccagatcaaagctttactgactaaggtgactaccagttcaggctttaggtatcttgagttacaatctgaaaaattcagtttaaaatatttctctcagttaactcatgtgtaaggaacttttcctgtaggcagcttgtgagtccacttaagtactaacttaaggtgctctctttaatacaaataataaaatagaattggaggagttattttaggacttctgtgactgtggggacaggcccggtgttggtgctagtgctggtgctcagcccttgttgctggccccacccacctcctgttgacagtcactttgattacagtgctttggtgtttgccagttctgttactgtggggaaaacaagtcttgcaggctgttaccagtataaattggttgttcagatttatgttggaattaacaggtcacatgcactgaattgatctggaaataaaatgataccaatgtaaccgtgtgttctagatgatctgttcttacttccttggaattttccaaagtgccagccggtgtcagccaaggctgtctgagctcaggtccactttgttctctgaatgaagattgatttctgtcatcagacacggtgataacacaaggtttgtgtcacctctattgtccttcagattggttacatttaaacatgtagagcaagctggagagatggcttagccgttaaatgctaggctcacaaccaaaaatataaacatggtagagcttgcacggtgtttgaaaacgaattaaaaatgtacagtactgtgttctggtgaagttgttttctgttttggagacagatattctgacagtaagttttttgtgttgcagaacacactgcaggccttttattatttaagtaaaaatttcaacagaatgactaacaagcataagcacacacaatgcttaggaaggacactagtccattgtgtgagtgttgagtgcaaaatttgcattcctagaaaatctttctcccaatcacaatacagaacacattctttaatatccgtgggcagcagcattaataacaagaaaacactctcaaaaaagtacctcttcttttcatgggatactcaacaaaaattgaattggtagtgagagaatctgtttaaacaaggcaagtggtttagatcttactgcagcagctgtggtcagctgagcctgggagtggaagaaacatggcttatcctgaaccctcttgagacttgtttatgaggagtgtgaaacacaggtgacatgactctaacttccgtgctgttttgagttaagaatgtgtgatgttagttacatttctagtatctctaattttcgattttataagaagtgtttttattgactttaggaatagtgggttaggaggaattaggggcatgaatgttggaatctgttagtgcttgggttttagtttctgtttattattgttgagtgctgacaaggattttattaacaatccagcagaccagtatgtcagagacagtactttgccattgctttcattaaaaaatactggtggtagacttgactttgtgtttgaagattggattagtgttattgaatagattgaaagttgtgcatggagtgtgtgtgtgtgtgtgtgtgtgtgtgtgtattttttaaaagttcccctagtatttatactctattataaggttgagttttggccagaaagattttgagtttagaaacttgtcagttttatattgtacatgaagacactttacagtgaagataggcttttaggtccaactggttgatttcctctctatttttaatggttccttatttatgatttcatttgttactcttctgatatggtgctcttgtatttccacaatgctgttggtgaacacttcctactagttcaatattaaacaatacttttatatagtatcaacattttataaagaatgagcttagattaagttgattaaatatatttgtctggtgtgaaaccaagattctttgactgaaagctcatgtttcagccactgggttctctgtctgtgtttcatgttttccttggtgaaccttccttctcacatttggctatgatgaggtgtgagagtgtcaaactagcacctcggttagcctgccagtctaacctactttgtacaatacatgatacacaacagcatttgttggttatgtagcaaaaagaaaaggaaagtgatttaagaaattcctgcttcctcaaatggagaagagggagagtaggagggcagttagctgaccctgccattccttagactccatttttctacaaagctgaggtggtgccttgaggtatggggatgtttgaggtggtgtgtgaaacctgctgtctgcagacattattgtttctttagcagcattaacaaaggatgcttctaggtctggtaatgtgtcagtacttctgtgggcactcagaggtgccaacattcatttgcttagcaggaattttcttaatttgcaagtttgcatctttagtcacttcaaaagaaaccccagaaaagtaggttctttaacttttgatactgttttgaaaaggacagagtaattcctgtctgtctgctgatacctggcctgtgttactgttcacatcagtgctgcactttgtggtagtagaagttttgaataggacagcaaaggaagagggcattgtggtaccacagtagatgagtagctgtatgagaatgactgagtcagatgacagggttctgtctggttctcgtggtgcgtgaagcactgccactgacagagcgcagggatggctggggatggagactgagtgctctcgctgttctgtgccctccttttttgtatatgtgcgttctgttctttcagagctatatgggattcatggagaaataagcattcaaataataccagctttattctttttatgtaggaatttggaagagtgtaatttgggctagaaagggaagagaatcttggattgacttccattttttagagtaatgatgagaatttagataaatgcattctcccaggccagtacacaaccattaagttacaccccagctgtttgtgagttgttaatggtcttctttaatacagtacagtaaaattgtaatgctgttgtgaggggtagttctcataggaaaaactgtccacctgaataatgtaaagtgtaatggacatcttggacagtgctggttatattctgaccagttttgctgtaatgcttcatcagtttctaagatttgtgctgcttatgcttcctgtgttgacctaactttactttatgcttcctgtgttgacctaactttactttctgaagagaggcattaatgctcgggggcatggagtgttgtgatcactcctgttgcacagcatagttgactctgtgttgttttgaatcttactaatatttacatgttatacagtgccttagaagttgctagttagggctttgagctttgtcagtatatgtttaataagtatgtgtatgtgtgtatgcttgtgtgttgtgtttatgtgtgtctatttgtgtatgtatttgtgtttatacatatgttgtgtttatgtgtatatatttgtttatatgtatttgcatttatgtatgtttgtgtttatatgtgtgttttatgtgtgtatatttatatgtgtatatgtgtatatgtgtgtgttcctattgaaagatatataggaatagaagattgtgattttaattttagttcataactctgcttcctggctcaggcaaaaaggcccacactaatcaggaataaaaaacaaataatgctgagggtcaaggctagcatttttcaaatgtttacatttgtgtgtatgtgcacagactgggagaggagagttggggactatttttgctctcaggagtggaagagttattaaacctagcttaacaaaatgatttcagtgtttgtaacagtagctctcagttcctgtcagtcttgagtcttatagtctccctctgctgacactgattatgggaactcttctgttttcttccttgatttttctttattttgagacagcatttcattaattctattagcaggctagaagttgctacctttccttgcttcctaagccttagggggcctgtccttccacatcctgccaactctggttcttggtgtttcggttgtgggcttagcctttcacaaacggatgagccatctctctatccctaactccgtttctttaaggatcagattggtagactttcacccattttaactttccacttctgtactgaactccattgtggtcaactgaggttttctaatggttagatgtccttttctagcctccgttaagtaaaataacagttggcatggtattgtttgtgaggaaatgtgctaagctgttagatgtattattgtattcatcattataagtatatgaatagctcttagcattgctaagtactcagtaggtattaactaatttatccaataagtttaaataaaattaaacctatgagtgtctatcatatgccagctattatcatagagctaggctagtgtttatcatctttcaagaaaattattaccctcctaaggaatgttttggcacatttctctgtcctatcccctcttcctcatgctcacacagtgggtatgattttatctactgtgtttgggaattaaaataataaaattttcactgattgtgttagtatatgcttgcaatgccagtacatgagcagtggagatagaagagtcagggattcaagactagcttgggctacataaaactttatctcagaaaccaaaataacatttaaaatttgttgttggtttttttttttttttttggccctacctcagtgggccattttattcacacccatggggctcatattctcccattgggaatgtgtgttctggattctggggatcccataatgatcagtatcgataggatgtggaatccttaaaggtttacacttaaaagaatgtgggacacagaaaataaacacataagacacacgtgatgctgtaggaaggaaggaaggaaggaaggaaggaaggaaggaaggaaggaaagaaggttgttaatgatacattttaaatatgaactgactgtgagcagaagttcaaaaaaggccaaagggaaaaccaggaatgtttgcaagaaaagagtcatcaggagtggtacccaacggtgcctgcagggaagccatagagcaactaggagatgaggtcaggacagcagcagatagcgagacaatgcataggtcgtttgttttaagggcttcacttaccctagcattgacatgggaaggcttaggaaagttgaggagagatgaatgatgatgttggttgctgtgttaagagtgaatggaagtgcagaggcaaggcatgtgttttaggaactccttcaggagggaaatgatacactagcagaagagctgtgtcacagtgattagagaatgcatgtgtttcgaaggccaaagacgttcttgagaaaaaagtgaaaaatgtctgggtggtggtggcacatgcctttaatcccagcacttgggaggcagaggcaggcagatctctatgagtttgaggacagcctggtctacagagcgagtgccaggacaggctccaaagctacacaaagaaaccctcttcttgaaagaaaaaaaagtgaaaaacaattcaagtttttggttggaggaagcagaaacaagcatagagttagctttgggggtctgtggaggcacttaaataagtaatttgttgaaatctgagtctagggaggtctagagttgacctggaagtcagggttccctcatgtagaggtggcagtgttgaaaggcccagtgaaattattaaggagggttatcagtgtcctggacaggagcagttctattggtataataaaagccctaatgaagtggggttaagagagaaatcttgctctgtaacacaaggtggactgcaagggctttaaaaggcctaggctaggtaagaagccatgattcaggctgaatccaggctttgtgattgagaagttttctttgggttcatttggttatgtggctataggtgtggaatagcagagagctggattttatgagtttttggaattaggactaggtgttgttggatatagttcagtctagttctcagagtctgagacaggagggttcgaatagggggaagccagcctgggctgcatatcagcactatctgtcaaagggaggaaggaggaaattgagaatattagagtcgtggtgatcctggagcaacgtctttgagaaatgagagtttagctatgatctcaacagggatggtttgcatgatgtgggtttaggtcagtccactccctaggcccagacacagaggagaggtgtaggaaagtagagaagtcactcatttgtgtgtgtgtgtgtgtgtgagagagagagagagagagagagagagagagagagagagagagagagagagagagagttgggtgtgtgttatgaagttgtgtccttagggcaaaatctggcattaggaggcataatagatgaagaggccatttaggaagagctatagtgaatacagagtttgtgtaagaagcatgttcaagcccaggaggatgctcattccccttcagtttcatctctgtcagaagcagagaaagccaggtagaagagaccagcttctgtggcagatgtgtgtatatttcagccactcatttgttactctgtctgtaaatgcattctgtggcgctcatgtactggctgaattgttgactaactgatgcatatacctgattttaaaggaaatatttagaacagtatttgatggaatactcgttcggtacaaggtagtgttattacatgatgtaggcagtagccaggcagcctcagactgaggagtcaggctagagaagtgtaagtggcacttgggatagaaaggtggaaagtgacttcagaaaactcatctgtgttaaggaggaactagaggagaatccagaggaagatgtgacagaaccagcaaatcttaatggcaacagaagaagcgtggctagaagacatgtgacagggtgtcactgacagtcaggttgaggtattcatgttgagttcctactaaatgactagcgttacaagtctgtaatacatgtgcgtgcttcctccatgtaaaggagactagaagaggacaggttgaagagcattggagggaaaactgaccttgtgtctgaggacatttcatcatctgagatgggaaggaagagttggtttgaatgaaaggaattcactagggtggggtaggaagttgaatccagccacccctcagcacctgtttccagtcctgtcagcttagtgttttcaacgagtaacagactgtggtggcagagtaatcgataggacatcttttattgatactgggttttctgttttatttgacgactctgtaatattagctaatgctgtgtacttattttaaaactgttttggcttgtactaaactgattttccatctctgattattatttttaacttttatttctcgtctgtacaccagtagatatatagttgtatttactaaataccaaatcctttctctactccttggatcagtataatttaatggattagacttagtcactatccagctttctccatggagtaatagctttctgcttatttagtgagcagatcaatttgagtagttttgcaagaaccccaccttcagtggcatcagcattttatatatattctttttgcattccctatctgtttaaccacttgttttttctgtgactcttgtgtgtcataatatggacctttctggttgtctattaagtaacttcctgataaaccaaaattcttccagaatttttccagcttaaacctttctcagtcacatttaatgcatccttctctgtgcacctgtagcacttgtttttaaagttactcttagagcatagttaaataagtatctgcatcgctggtgcctgttccttaatagcacatctaatactgaactctgtgcatctttacagtgggaagtcatgaataagtcagcatcaagtaaatggataagtaacacatgcacaaatgcatagaaagtaagctctgagcccctctgcctcctggtacatatggcagcacacatcagctccatctgaaaaattcctagactgaatccaccagctacacacatgattcagtttgttatcatggcggagactctgagccttaggtacctggtataagtctcacaagccccaggtgtgctaaccctacatgttgtcaacactgctgctgattgttctcaaagggtgctgacaacaaaaagttaagagccactactgctgtctaatagaaaaagatttttcatagtgacattggagggactggacttgagtatgttgaccaaagacattgctgtcaagtaagagcttgctactaacttctcagttacttcccttgaagcttactgatcggagtagtaccacagattgtttaaggattatttgtccttctctctgtctttttctgtgtagccctgctgtccaggaacttgctctgtagataaggctgacctcggacacacagagatctaatcctcttgcctctgcctcccaatttctgggattaaaggatacaccaccactgcctggctatttgtccttctcttcggtctagcatctttttgtttttggtttttgtttttttgttttttttttctagacagggtttctctgtgtagctttggagcctattctggcactcgctctggagaccaggctggcctcaaactcacagagattcccttgcctctgcctcccgagtgctgggattaaaggtgtgcgccaccaatgcctggccaggctagcatcttaaaggaagtgtttgctctagtgtcttaaggaacctttgcctgggagtgcatacaaaggactccagaaagcacaaaccttccttttctttcaccctccacgtttcctcaagtttctgttttattttatctgtgcatcctcatcattgcttctaaaagagtttgatttgaatcatccattcttttgatctttattctttcacttgtgtatttatccaacaaggactttgcaagtatctgctcaatgccagttgcatgtgagagtctagggacagaatggggtaactaacattcttctttcttgacatttcccttccttcttgaaatttgcaatcttatgatatgtagccaattattaaacacttgccaagctatataggagcagattaggataagtggaaagaaagaaaacatgaagtaccgtgagcttgctctgtgggtcccacatccaatagcattcctgaggaggaagtgatgtcccaccagccagctcccaaataataacacagagacttcttattatgacagctcagcctatagcttaggcttgtacctaactagctcttataacataaattaacccatttatattaatctgcattctatcatgttgcattgcctctctgtttactctctttgtctcccaagtgcctagattcttcctcatcttcctttctctccttggaaatcccttctatacctcatgtgtagctatttggctgttcagctttttagtacaccagtcatagcaatcaatatactttcacacaatgtacaaataccccacaatatttcctcctttttatctaaataaaaagaaaggttttaactctagcaggaaagctatatacaataagaacaattatcaagtaagaattacatccacaatgtttagtccatatatatttggcaaatttggagaaagtgctgtatttatactatcttagtgagtccaaagttttatgcctaaaccattttcaaccgtaacatgtattaccatcctggaagtatctttttagaactaaaaatatcttcttagataaacaagatattatgtttctcacccttataaacttttcatctcttatgtaaatttttttttctgaatttggtaacaaggaaaactctataactgtctcatcttcaattccatcagagactggagaaatatacaatactatctgagtaaacgggaactgcagagcaagcagcttccaaaacagtataaatgacagagacatctggatgcctggacagtcatccaaggttcctctgcaacattggggcatccatcttcagcctgcaggcctacaatatctgacaaactttactgtaaagcccagcgttatcttggcaaagctcagcagcctttttcctttgtgaccagtttggacagtatattgtcagcagtcaggcaagggcagtttcttacccaaatggctaactttgccatattgaaggcaaactctatatggagtttcctcaatgcctatcatcctattatgtagtagattgatgctgctaggagcagatgtttttcactatcataaaaagccttgtgttattaaaacattttaaatgccatattctgtaggtctttgaagtgtttgaagaccatttatttaaaatatatctgaccttgaaagcatatctaatatgactataagtttgattgttatagataactaactaataacctgtcttttgttgttatcctaaatagctttcaaggactaagactttacattgcctttttaaaagagctgtgtaggcatattaccttaaacaagaatagaaacatatacagtataacaataactttaaatttgtatcaatatacaaaaatatctttaaaaagagtagaaatatatatagagtatgttctgacaaaagcaaccttaaatttgtatcagtatatacaattccataccagtgtaaaatatttgagattaatagttgctttttagttaaaagtagattcaataattcacccctttattctttcattcctatattccttttttctttttagaaagatcattgcatccaatctcccttgcttagtttcctcccttaccatgaccagtaacaatttgtaaccaacctccctaaacaatgaaaaacatccataaatcactggatgaccagaaaccacccatcccacctcttgggaatgtgggcttcatgttctttaagctgcttcctgttgtctggggctgatggcatcttcaggggatcctaagaatgttgggataatggtcaagtcctgagaaagctagctgtatttttttttttaactttgtttagtctgtgtgatgggaaagttgtagagcttatctgaagttttggctgtagtctgtgaggctggaccatctcagctagcagctttgaagatgttcttggtgcagaattttgaggaaactgtaacagaggcgttctgaggggctggatcacttgggctagttgtctttattagtgtctagtccttcatctttttctaaaaatacacaaaacttttaaaggttatacatctgtgttagcacagtatggaatgtgcagtgtgcacaagtcagctaaagatgattttttgttctatttttgaacagataaagggtatttgttagctttataagtctgtttggactgtataaccaaacctccatccatgtcatatgaaagaacggcatgtaataataagtcatgaggattctgtagccaacaagatttagcatgtctcatccagtcttaagagctgttcccataatagagggatcacctttgtctttcttggctttttcctttatgtctttagccaagatcctcaggaggtcacccaccccactcccacccccatcgaatctgatcccgattatctttgtggaaataaaagcacaacctcttccccaatgcaaccattgtccaacttccattttgaagtcaagacatccctaaaatatataagctggattaatttagcagttccttccaaaatccagagtgtctcagcagctgtcggtctctgttcattagcattcaaaaaattaaagttaacaaagtgccgtacatgatccagacaccctgtatttcccatttttatatgttttccttttatattaccttactctctctttaaagactttgttacttttaaactattttttctatgaccattctcttttctttgacatccaagtacatttttaagcacactatacctgtccagaggttttcttgatctgtgcctgacttttgcacatctacagtgttttgtgatggcattagccaaaccttaaactgctgtcggcatctctctctcgggttcccccacgagcttagctttctgcctgtgggggctgtgtttaccgccccagctctgggaatttgttgtatgtgcctgaactacgagtttgtacccagtgccagctgctcaggtgctctgctgcacagccacacatctgcatactaagcctacctaagaaactgcagtcacccggaagctgtacttttttttttttttttttttttttttgtgaagctttcttaggccttatgtggttatatgtggtcccatgttgggcaccatattatgtaacaagtccttttctatcctgtcagtcagctcccaaataatggcatggagacttcttactaattatgaaagcttggcctatagcttaggcttattcccaacaagctcttagaacttaaattaacccaattatattaatctacattctaccacatggcattacctttcttctctcttgcacctcctctttcctctccatgtcttctggcatcatcaatgtgcctagattcttccacctcttcctctctccccagaaatcccatgtatacctcttgcttagctattggcctttcagctttttattacaccagtcacaacaatataccttcacacagtgtacaaacaccctacaactggtgacatttcaggcgagagctgaaattgaagatggtgcctgaaggaaccatgctgcctgaggaagtctgtcttatttaaggatcacagggaagacttgtttgttggactggggagaacaggggagatggatacacacagaaagttggagaagtctggggtcaattagctcatgtagtgagaaatttgtggtaagactttgttgctgttatttgctattttggggctaagagattactgtataacccaggttggcctcaggtctgtggtaatcctgcttcagcttccttatgcctaaaattagaagctgaatcagtacaacggcctcataaaatgatttaagctagagaatgacatggtttatttctacctttttactattgtgaataatgatgctgtaacatttatgtaccatttgtatctgtttgtgtgtcttgtgaggccatattttcatttcttttagggctatctttggaggtcatagtgtgtcttagtttcatttctgttgctgtgatacacactgcccaaaagcaacttagggaggaaaggtttatttggcttacaattccaggttatagtctgttattgagagtaagtcaaggcaaaaattaaagagcagctagtctcatcatgtcttcacttaagagcagagagaaatgaatgaaccaagctgtctatttgccactatgtaggctcaacaacttcttcacttttacagagttcaggaaccagcctaaggaatggtacttcgcacagtaagactggctggacccccatcatttagcagttaaaacaaacccacatagacatgttcataggctagcctgatctaggcagtttctcaactgagttctctgttcaagttgtgggtagttgacagaactaacctatagtgggaaattaccaatacggagtcagatagaaatataagggtatttaatagggaaaagccttacttacagagcgacctagccagccggcgtggtagcagtctgtacagcaagtaccaaagtgaaactgaaagagcaaacgcaatcacaccacgtcactctgaccacgccctcacaagcgtggtcaggcacacctgaggccagtccctaagtaggagtggctacagcttcccctacactaaccattatgtagacttactccaatttgtccatcaaaagtgactgtaccattttgcattccactcaggaatgtttgagtactagtttctctacattttgccaatatattatgtcctgttgtgtgaacagaaaatagacacataatttgcagtagtctaaggatggggtgttgaattaagactaagagcatctcactgcagtaacatgtccagataatatggaagtagatctacaggactttagagtgatgaggtgagattggtattccagctagtttatatccacttgacacaggctggcatcattgtaaagagaaaatgtccctaccagattggcttgtgcacaaacctgtgacacatcttcttgagtgatgataaatatgagaggtcctaactcattgtgggtggtgccattcctgggcaagtggctctgggttgtaaaggaagcaggttgagcaagccatgaggagcacccctccatgacttctgcatcagcttctgcctccagtttcttgctttgaattcctatcctgatttccctcagtgatagaatgtgacctgaaaattgtaaaatgagatgaactttttccaacccaagttgcttctagccatggtgttttataacagcaatagaaaccctaactggtagaacagcttgtagaacagaagtagagaaaagatagttttggttttcagaaatcacttgggacttggaattgtgttttgacactactcatagttctagatgagttttacatgaagtcaatgtcatgatatctttcactgacagctaagctttaagatgcctgtgaaaatgtcatataactgattacactacagagctgtaaaccggtgaaaatgtaaagttaggggttaacatagcttcaggttacaagaggatattgagggtttgccaaaacaaagtagaaaatgaatgctcttgagttcagtttggatagaaaggggaagtgagacaggcaagggagagcagtggattagaagaatggaagggttgagggactggtgtctgtatggggctgaagactatatgaaaagcaagtaagaaagcaagattgctggaaataaaaaccgtgtggtgagaaattgagttcctggggttaaagataatagaggcagagttgttctagaaccgataaggctcacattgatgaagtgggaatgtagatgaggaggagtatatcctgatggacaataaaattgccacacagatagcagctttggaatggaaaaaaaataggaaagggccaggtgaccaggaaaagccctttgtgtatgaggcatggttagttaacaagaagggattgcaacaagttgtataaaaggccatttacttcagaagtcttttacatgtgaagatagaaaagtacattactataggaaaatgagaaatgagctagaaaaatgctgagtttctttggcctttattagatgtggaaaaatttaaaaaaagaaaaaagctgccttcattcaaggggctcggggaagaaaattcctgggagatatcaactgaggtagaggttgtgagaattctgctgcagatgccaggggtgtgttctctgtggagtaaagattccagcataaatgttgagaattattgatggatatcctagacagaaagtgggtggaagaaactgagtaatatggtaacagacattcataactaagagatgactagaatcagaagcccagcatagcaagaggaacaaggacatggggtggactgatgaagtgatgaagtaatgaagtatgtgcttaggaaacctgaggaccaatttgttattgattgataaatgatgttagcagactgtacaatgccctgagatctagtgtattgccagttacaaggttcttattgtctggcagcttataattcacaggtgaggtggccatgtagctgaggctctccagtgttatgaagaaagtggttaagtgaagttaaagactgtggaaacataagatggagagtttagtatagctggaaggcctggggacttcttggaaaagtctaggttttccctgagtctgataggaaaagtagcatgttaataaatgggctgagctaaagaaatagtctgtgtgggatggcatgatgtttgggcttgtggaacaattggtaaaacaagtcttgacatgaagatgagtaatggagaaaatgggaggggaagaaaagtgggaattagatgtgttgtattaatagccgtggtgaccagagcatgcacatactaatatgtgagaaggaaaaggaggagggtggggtgtcctgaaacagagttgtgcttctttgctgtggtacctcaatctgaggaagcccccttccctgcccgttcacccccagcagcacttgatgtggacagcagcttttggcaatcctgccaatgtgtgtttctgatgtcatcacagggagagtgttgtgccacatccacaccctgtaccctccactttcatcttgtctgaaaagagaacttaaaggctggccagctggttcttgcttgaaaacccagattttaaaatctgagattacaaacttgatttctcttacttattttttcactttgcttctaacagttatttggttccttgatgccacattgctctatcaatatttttataaataatgtaactaagtagaaacataatttggagttgtattgcttttaaaagttatccttattctcacagaaggttgtgaagtagtcctatatgtattttaaacttacccaaatggaatttagggttgctgtattagagttttgtttagttgtacaaaacagaaaatcctattgcagtgatttttggaaattgatgttcatttattctatgtgacatgaattctagggttatgggatggctgcagctgcccagcagttttgtgaggtcctaaagacccacctggtggactttttgtaacccccccatccccgtttacagaatgactgcaagagaaagggaagacaataaggcctgtcttgcatatatgccatactccgttttagtaaaaagaggtctccaattgctattagcagacttcgaatctgatttcagtgactagaattgtctcttctggtctttgtagccacaagggaactaaagtgactcttgtcttctcaggcccagcacaggatgctatgggagaggaaaggaactcttccatggagtggtgaaaatgaacatggattacaccatggtcttaagttttatttcaactgctaaggcaaacagtgttaatcaaaagctagatgcaatgattttgtattttgttcatttatttgctacttgttattgttaataaacaggcttaagatggacttgtttattttaaagctaaaataataaatattgtcacaggtcctaagataggaagcatttcaagaaaaaataatgaaacaaatttagactttttatgtaaagggttagggttttaatatatttgagaatgagaccttaaaaaatacatgtttgtacatggtggtttatacctgtaatcccagcacttggaaggctgaaggcaggaggattacaagttgggtgttcagcctgagctaatttaaaagtaagtgtgtgtgtttgtgtgtgtgtgtgtgtgtgtgtgtgtgtgtgtgtatgtgtatgctcatgtgtacgtatatactaacatacatatctgtatacatattttaaatctgcattttaagctttaatatagtgtcttttcattgttaacttatttgaatatttttaatttaatattttatatgatttagattttttagaaataaattaagaatgcattttttatccttgagggacttaaaatgtgtggggactgagttacattatttgacatcagtaaacaataaaaagtgtaatgtgatcaagtatcaaaagttgaattcaagaagaatggtaactgttgactgtgattacttccataacagtccatgacaggctatgtgagagtatggagtcaaatgtgttaggaggccccaaggagcaaaggcgggtctgtctgcaccacccagcctcgttgaactacatgcagattcttggatgttctctgtgttttcatgttgccatacctttagcattttttttatccatgaaaatttattgcgtaacttcttttaaatgattagttttttaaattttatattactgtttcattcatgtaagatagtattatatgatacattgtatggtacaggtccctcagaaattctaaggctctcctatacttctttgaggaagtaaagactcctcagacagcatgtgaatacatttttaaaagaatattaatggaacagaattttaatagcactgcactaaccagcttcaaaacctgggcggactctgaattgaatgctggcctttatcaggagattatcattgatgctttgtggctgttcagcatgcgcacaaaccagcacctgacacaaccattggtattcactgtgttagtgtgtttactgaaccatgaggtttatgtcaatggcagcagaacttttctgtaaaaactatgtgcaccccccaatcaagcaatattttgtccaaaacttactcactaatgtagaatattaaccaatccattagtgagccactaaaagaaaaaaaatcacaaaaagtaatcattaagttttaattattttgttaacataaagggtttggaatgccagttaaacatcatgactctgtgtactatggtcagacagtgtttacagcacttttttattggcctggcagtttactctttcaggactcagctcaaatgcaaatgttcctaggccatggtcggtggcgggtgcagtttgcagcaggaagactaggttccccaccagcctggtaagggcaattgagaacttgcacctaaaatatagtatttttagaaagggctagaatatagctcagtggaaccacagcctggcatgcacaagatctgattcatgtgccatcatgtgccgttgcctaagttctccctgaattttcaggtgtgtgtgtgggggggggggtttaccacatggcccatttattcacttgcaaggttatgtcacaagctcatgaaccacatgcacatggggactatgccaaatttacctttgagtcactgtgcctgatgtgtagtggttttgtatattggaaagttcttgtaaacctttttacacttattgattttgggtgtatatgtgtttatttgggtgctcatgcaatgacgtgtgtggatattgaaggacaacttaggggaattgggatggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttggggagctcatatcatcaggctttgaggcaagcacctttacttgttgagccatctcaccagtccccctccgtgagtgttctttagatgaataagtaagtaactgagtggatggatgaatggataaagggaaggaattcatccaaatcatgaatattgggaaagtctattcagacttgagattcaagcatacttaactattaaagaacagggtctgaaaatttcctgtctttagaaaccattgaagaggtcacccaggacttgctgacaatgcaagttgcagtaaatattggagttacaaaccaaacatctaaaattggtcaacatagctccattttccaaaacatactgtgttttcatattttctagtgcttccacttctcattcagagaactcggtgcatacgaaatcagtttctgccatatcttcagattccatttcaacttcggcagacaacttttctcctgatttgagggtatgtatgctgcgtgaacatactgaggatggccatactgttcagtgtctgaccagcactgtcagcaaaacctttaataattaagtaggtcgtggcagagagttctcaaagaccgcagactttataaattctcccagaccaggccagcaagtttgaatgcttgcttacgattttattttatttttttattttttatttatttatttatttatttttggttttccgagacaggatttctctgtgtagcttttttttttggagtctatcctggcactcactctggagaccaggctggcctcgaactcacagagatccacctgcctctgcctcccgagtgctgggattaaaggcgtgcgccgccaacgtctggctacttaccattttaaaaaatgtacatttcattccttaagttagtactttaaaatattttgtctaatttattttgtggtacttttttcccaatagcttccatattaccaggcagtaataactaacatgcattgagaacttaccataagccagttaactgttgctctaagtaaattatctcttgtaatacttgagatgttttgttatttccatgtagtatcttagattaatatgtccagagattcagagctaatgtcatggctaatcagtttagttatgtttagccagttgtattagtcagggttctctgaagaaacagaactgatagaatttattggagtgtcattcaggctgtgatctgagtagtccaatgaagggtgtctcctgatgcaaaggccaagaccctaatagttgttcattccacaagactgagtgtctccgcagtcccaatctggtactggagtcccagagaattcgtagagagctgccagtcttcagtctatgttacatcagtgaaagaaagcctcagcaagagtaaatgaacttcccagcaagagtgagggcaagcaggcaaaaacaaaagcttccttcttccatgttcttttatgtggactgccactgtggtgtggctcagatataaggtgggtcttcccacttccaataatctaatccaaaaacaaagaaaacaaaaaaacaaaacaaaaaaccctcacaggagtgcccagctgcttgggctttagttgattacagatgcagtcaagttgacaaccaaagctaacctccacaccaccgttctatcttgttgagtccaattctgtagttactaagcaccaggtgatggatcattcttacacatctcagtacattgtaaaatatccctgtatttttgccttatttctacagaattaaccacacatcaatgatagcatatttgtggattcatctgcttttcttcaaccacttgcctgcctctgcctcccttgagtgctgggattaaaggcgtgcaccaccaacgccctgccagagtttctttttaaacagtagacattcattttcatggttctagaagatgggaagtctaggttcaatgctacagaccagtgtctgcaagcatattctatctggtgttctgtattatatgggacgatctaagagaagtttactccagattgtaattcagaatgcctctctctggcagcagggaggaacagtttctatgagctgaaccctgaatagctgtacaaaggcttaattatttttacacaaaagtcgatttttttttcttgtaggaataaatactgatctactaccagaggccccatagattgccaaggcctcctaactgacacccatgttctgggggtctggatcaggtattcacaggtagaccagtggcatagaattgaaaaccctgatatcaacccacacacctatgaacacctgaaatttgacaaagaaattaaaattatacaatgtaattgagaaagtattttcaacaaatggtgctggcataactggatgctggcatatagaagactacagatagatccatatctatcaccatgcacaaaactgaactgcaaaaggataaaagacctcaacataaatccagccaagctgaacctcttagaagaaaaagtgggaagtacccttgaatgaattggttcaggagaccaattcctgaacataacacaagttgcacagacactgagattgacaattaataaatgggacctcctgaaactgagaagcttctgtaaggcaaaggacatagtcaacaagacaaaatggcagcccacagaatgggaaaagatattcaccaaccccacatctgacagggggctgatctccaaaatttacaaacaactcaagattattttcttaaaaaactaggtaacaggatatttagaagtacctaagaaataatcatagaaaatcctgaattggaatttttcatgtaagcatcaaagtacctgtttctaaaatactgtaaatgaaacaaaattgtgaaccatctcaaagcataacagtttatggaggaagaatttgttagacggctttggctttcactacattttatagacagtttgatataacagagtctcaagctggaccaaaaataattttaggtgactactgtaaagtaatccattttttattgatcgtaattttgatttaactccttttggccgttatgaaaatgtaagaaacatgtaattatatttttggacattgcattatgtagaagaaatatttttaaactttatttgattttagtttacttttatctctttttaaaattcattccaagcctgtttcattgctatttttttaattttttatgttatacaaaactataaattaaaaaatttgaccaatatacctgattttaaccaaaacccacttttacctgttaggcttaaccttgaaaacacatataggctaaagcttgttcttgtgaatgaattaaatttgaacttagcgtaactataaacctggccctgagcacatttaaaaaagtgatcatttaaagtggtttaccattaacttgtatgtcttaaccatcttttaatagtttataacaagttagcagcttttaaaagtttcaaattttacagctttactagacatacatctctaagttaacttctgtcaaccctttataatcttaagaatttatcatcacacaaaattcattctaatctaaaatattttgggtctaagaaaatttttaggtgttgccttttactaataacagctacagctattcttgactttcctcttaggcagggttttgggtattttgttttgttttgttgttttggttagtgttcttttttgtttttgtttttgttttatgagacagggtttctctgtggctttggagcctatcctagaactagctcttgtagaccgggctggtctcgaactcatacaaatccacctgcctctgcttcctgaattctggtattaaaggcttgcaccaccacggcccggcttggttagtgtttaaagcaaggaaactaagttaaaggagcacattaagtgttttttaaaatttttgtctctctttttttatttctatctccaaactgctcatgttatgcattctttcagatctaaccaacaacataccaagaagccactgtcactagcacagcacatagacagtgaagataacccttagaactgggggaatgcctttaatcttgtgtttcatggagtcttacaaaaaataatgacaagtattttagaacctttatagatatccctaaactgtcttcatgtgtttgtttaaatgaaaaataacattctcaataaacattcaacagcaaagaacctcattactgaagctatttgtattttccactatatgcgaatacaagacaagccaggaagagtaaaatgagtaaaatcagtgtttgtgtggtaaattttagagtgactgttttctataagactatcagtaagagactatttctatcagctaccactgttgtagccacgttatctgaatagctggtaacctattctgttttaggtggtatatttttgtagaatttaatggagggttcccagagagtaacttaaggaaacaggccaaatcctcaggagtgataaacagataagagtataaccaacaatatagttcaaaattgtaaattttgttttttttttaatttaccatgaaaaattaatcattcattagataatcaggaaaagagaacgtcctcaatatagtcaattactaatacctctggaaatttaaatagcattggcttagtgatttatgcccagattgcaattgtttttatatcaaaagttgggctttttaaatgtttttcccataaggggattattgatagttattccctttattagggaaaaacaaaaaccatttcccatgaagggacatttaaatattgacttactcccaatatgaggggggagaaacatttaaacaaaaaaacagccgggcattggtggcgcacgcctttaatcccagcattcaggaggcagaggcaggcagatctctgtgagttcaaggccagcctggtccccagagcaagtgccaggataggctccaaagctacacagagaaaccctgtctcgaaaaaccataaaaaaaaaaaaaaaaaccaaatgaaacaaacaaacattaacaaaattctcagttgggggttggctgcattagctgcagcagtgaggccccacccatcatccttggaaattcaggtgttgccactgttctgcattggcatgcccttagctgaaagagctgacaggcagcaagaagccagagagcggagttctagctgctagtaatttttcaatcttttggaaaaattctattcaccaataagcgaggataaaaagcttactttatttttatgatattttaggatttattgtgaaaatacgccatttttcatatgaatgtaagattttgtaattcttaggcactcaggaaatacttgtagaaaatggcagcttcatagtgtatgtagcaatactacagtttatataatttgatttaaagtagtataataagattgcaattcaaataaatgcagatcatctggatgaaatttgaatggaaaaaaaatagccttcgattaaaacaatgtttctttcttacactcccccatctaggtcctgagggagtcaaacaaattagcagaaatggaggaaccaactctgcttccaggagaaaacattaaagacatgggtctgtaatggtattttaaaatttgtttctttctgactatgcacagttgttcattctcctgtagctcccagcctgtgtgctgtaaacctagatccagagctgttgggtgtgtcctgtctcactgttgggaatttgaattactgcatttagatactgggttgctgagctagacacattggacatgtgatttttttttttaaattaaagtacagtctgtcatttgctccttttttttataattttcttccttagataaactcgggtaagttttggatgaagtctttcatgtgcattacagaacaagcactgtgtgtagacacggtctgctgcccagtacagtcctcatcatttgcgttgtgcactgagactgagcaggaaagctgtactgtgtgctcttgttctgttattcttgctcacaaaacaaatattcaaagattttgaagagcactgttaggaggatgaagaacatattttctttgctaaagtaaacaccatctttcatatttcagtcagttatcccccattaaaggaaatgcttcacttatagtgtaaaataggcatgccaaagcaaggacctatcctcagatgggctgatagtaactgccaacttagtttcttttccttccttccttctttccttccttccttccttccttccttccttcctttctttctttctttctttcattcattctttttttgtataaattttatttaaaataatcttcttttacatatcaatcccatttccctctccttaccatgatccccaccaacccccccccatcctatctcctatccactccccagggtgggtaaggccttccatgagggatcatcaaagtctgtcaagtcatttgtgggagggcctagggcctcccccatgtatctaagctgagagagtatccctccatggggaatgtgctccctgaagtccattcgtacactagggataaataccgtttccactttcagaagccacatagatccatcatttagcatttaataaagcattgactatgtctaaaattcgatgtcagaaacttggtcagggtatactatgctctttttaaaatatcttattccaaagaggtccagagatggcttggtggttaggagcacttgctgccctagcagaagactgggatttgattgccagaaccgtctgggtgctccttgagcctcggtcaacacctgcacacacacacacacacacacacacacacacacacacacacacacacacacgcaagtaaaacactggtaacacatacagaaaaaacattcattcaaagaaatgttattctgtctgcagtcttttaatgtctcagacatatagtcagctcaatactttctgatattgtatatattatggtcattttatttttaaagaaatagtgcaaaacagcaggtgaaagaggcctataaactgggaaatgagtgctggctctgtgttcatatgttgatcatctccctgccactccaacctctgacctgcttcactcagtagggacagcaggcaatctttgctccctcttcctatttctggagaggctccctttgcctttctgtttattttacaattcttagtgtaagacaaaattggaagcatggattaggctgctgaaggttttttatttaaatcattctgtggtttattttgtcacaattagataagcagtcaaattaatcttataaaatgtgtaagctgtttttaatagctattttgtcttttcagccaaagatgtgacttacatatgccccttcactggtgctgtacgaggaacactaactgtcacaaactacagattatatttcaagagcatggaacgggtgaggcttatgagtttggcttttgcctgtacatttgcttggtgtttggatgggtttgctcacttctgatttagtttttattattgagacaaagtcttatctgtgtaaccatggctgtactggaacatggtatgtagatctcaaagatctgcctgcctcagcctacaagtgctggggctaaaagtatgccctaccatacccaattaattctgggtaatttttgattcaagaatttctggttaagattttaccagtttggggggatgagtgttggagattgattgaacccagcgtcctgtcctgttggtgttattaaagcacttaacagttttttagaagttgtgtgttttcttttcatcttgcaggaccccccatttgttctagatgcttctcttggagtgataagtagagtagaaaaaattggtggtgcatctagccgtggtgaaaactcttatggcctggagaccgtgtgcaaggtaaattttacaacactgtgtggttgtatttactttggaaagctattaagtagaacctatacttggaaactggtacaagtcagtggactgcatactagaaatgtattctcatagaagcaaatgttttttgctattcacacattggtttgggctgagccagctgttaagacttcctgaagtggaagaacttcaggcagtttggtcctgtctgtctagcagaagagacataacaaagtgagctcctggaagcagtaataaatcagaaaatgatctctatatgcaagtgaaatgtagtaacagctgatcgtgttttttatttttaaaactcaagttctggtaattaaactaaggttcttgtgcttgtgaggcaagcattttgcctactgaaccatctctcctgcctaggaaaggacaaatgttgatagtgtgtattcgtcagttatttacatccccttgggccctactaagcctagacacacaggtctagattctgtgccatgtagtggagtactttgtgtttcttctgctcacagagaatcattgctactttgtgtcctggaacaattgttttgtatcctatatgtagagctttacctttactcaacatttccaagtaatttcatttcttcactaaaaaggaacaaagtgatttaactggatactgtatcttttctaggatatcaggaatttacgatttgctcataaaccagaggggcgaacaagaagatccatatttgagaatctaatgaaatatgcatttcctgtgtctaatggcttggtaaagtttctctctaacctgtaatgtaattattagtgtgatcaaactcaactaggttgtccagatcctcccctttgtgttcctgctttggcacttagccagaggctagcttgtgcccaaagtcaatttcagtaatgacattctataattatgttgactttggaggagggggaaaaattggagattgaactcagggcttcacacatgctagggaagtgctataccacagagtggttttgtttatttatgtgtctttatttgagacagggtcttttgaagttgtgtgggctggctactcctgcctcaggttcaggaggtctggactacagcctgtctctcatcttggctgtcttagttggtgtnnnnnnnnnnnccccccccccccccccccccccctttttttgaggagacaggatttctctgtgtaacagccccggctttcctggcactcactttgtagaccaggctggcctcgaactcaaagagatctggctacctctgtgccttccaagtgcacctacaattaagtagagtagaaaattccacctacaattaaaggtgtaaaggtgtgcgccaccaccgtcctactgaccacagcaactctttataaaggaaaacattgcattgtggtggcttaagttcagagatttagtccattatcattgtggtaggaagcaaggcagcatgcatataaacaatgtgctagagaagcagctgagtgctcttatatcttgactaccaggcaacaggaagtggtctgtgtcacagggtgtgacttgagcatatatgagacctcaaagccggcctccacatatcctgtaacaagaccacgcctactccaatgaagctacacctcctaatagtgctactcccattagaagccattttctttcaaactaccatatcagcttatataatatttttctttaggatgtttccatgattaaaagctttatgtagtcttcattagggtttgcaatcttcctggataggaactggcattaagactggaaatatgggtcagttattagttcagcagtattgtgacagtgataggttccctcatctgtatgatagaatttcacctaatgtcagccaacttcattcccatatgaaaatcaggatggataaggcagataatctattaacttaatactgggtttctcacttcagttgcaatttttttcttaaatactacagacttttctagtcgaatttaaaaaaaaagcttttatacactaaagtataaaaaggtcccttagtgtattagaacatacaatattacagagccactcagctgctgctgctctgtgttggaccagttatttctgttggaaagtgcatttttggagatgtcatttattacttagaattaaacctacaaaaactgccaaaatattttaaagtaataggttagcatttggaaaattttatgagtgggtctttgagcttttctgtacttcttaaaatatataaaatacttagtattgtaaattaaacagtaatttcagtcataaaactaaaaccattttaaaggaggaatttaaaatactcttgcagataagctaattaaaacataagtaattataaccctttaaggacatatttctgattgattgctttcttaaatgtctttttttaacttgtttattttgtagcctctgtttgcttttgagtataaagaagtattccctgaaaatgggtggaaattgtatgacccccttctagagtatcgaaggcaggtatgtgcttttctgttctagctttcatgctctgtattattttcattacagacagatcagagtcaggagttctttcagtgtctcttcctttttggtttaagtgaaggctaaccctggttcgcttggcttttcctttgaattgctttccagaatacactagtgatctacaaatctttgcttatctaggagtttgtctgaaaaatgtttgctctgtaaagatgtaaacagaatgagtatgtgtaaaatttaatgttcttatatgccttaatattattcactcagttttttcttattaggcatcctataatttaattatgaaaaaaataactattgattctaatttagctctgcaaaattttgggttttactcttcacagaggatagagtaacactttcccttgtgctaagggcagcattgacttaatttggtcagtacccatttattttaacgtacgcgcgcgcgcgtgcgcgagagcacgtgtgtgtggtgtgttgtgtgtgtgtgtgtgggtgtgtggggtggtgtgtgggtgtgtgtgtgtgtgtgtgtgtgtgtgtgtgtgtgtgtgtgtgtgtgtgtgtttggtcagaacccatagattttactgtcagcgtgcatgaatgtgtgtatgcacacatgtatgttgtgcctgtttgtatttgcttgcatgttttccatgcactagggattgaattcatggcctcatacatgtgagacaaatactctactactgagctatatctccatttttcatgtagatcaaagtttaattcctattaatagcttctcaaatattttccactcaactttgattcatttaagcttgaagagtatttattaatgccatgtgtgtcctttctgcttttctctactggagtcaggtgtttggtatttgttattgcttatgctccagtagagagggtactggccagttttctcactgctgtgttatcaggatgtagcagtgcctgacatgtcatagacaagtgtttgttgaatgattgaatgcatgaggctaagggaagagtttgcttacagtgtgtgctatctatgttaactaacaaatttttgcatactggtttatttaccctgtggtacttaagcacatgatgtaaaggtactaaatattatctgcatagcaagagtaaactgaggcatagggtcattaagtaatctgtccatggtaacatagctattaatgtggaagttgggaattgaatttgcaaaattatatttcagtaggtaagttagtattagtcagataccaacctgtagagctaatagatgagttaatctggaagatgactgtaaagaagttcatacatagacatggagtactacagtagagcatcagacccacaaagtcttaaaagtggctagaagaaataattctgttgggctggtgagatggcattaagcacacaagcctggagacttgagtttaatcccccaaatgcaaatcaagcacacagctgttctctggccttgacaggtgggctgcagtacccgcctttacccttctttatgtccattccctaccaataataataaattatttctttttattactgtcttttaaagaaaaaatttggctagcagtgtctgaggctatggaaatacacagcatatggcaattgataattcaggtgtcaacccaccagattctgatggagaaaatcttgtttatcaaggcttacagggggaccactgactctgaaaatgggttgtctatatctgtaatttttctcatgtgcacttaatttctttcctaagaatagctttggatgttttcccactgctcgtgtgtttgtcttgtaagaatattctatctattgtgggtggtcaggaggatgacttttcatttagctatataattttgatatatagaaaatatactaggacatgcttcctaactagatatatttgtctaacaaggactatagacacttaaaagcctgctttgttcatttttctctgactaactacacacagttagcttactttcatctcagagcaagttcaaaacaactaggctaaaagctttttgtcaatagatcataagtttaaaactttatagctatgcacaaggtcagagtcgaagatgtctgacccggttgctgcgcagagcaccttaggaagggcatgaaggttctttgcttgccaatctgttaacaatggacctgtgtctcagggtttgtcactgagcactgtgctccccaccccccactcccaatctggtcatggtcttggtcctgtgaccttgggaccttgtgtttccatgcaatggctcagctccttattgcttactctaggaatgtgtttttgaccaatgaaaggtaactcttggaagtttttttttaatcgtttcaaggctcctgtaaggagaagagtttttagaatagaagaggaagctggaggaagaagctaggaggaattgcaaatagacaggagaattagaaacagaagaatagagagactgattcagaaaagcacataatgaaagaattctttcaccctcagatatcctaagtcctccaattgctgttacatccatcctgaaccctgagaagagggtcttggggctgggcaccaaaggctctcattatggcaaattgtttttcaaaagtgaaagtggaggctagaggatagtgtgacctgattgtacaatgaaatttgctggcttaattctttatcagtaattatatcttgtagaaatggaagggaaataaaatcatctcctgacagagtactaatgaccagagaaggttctagagaatgtatactatgtatataccacagcaaatcagttaccttattactacctgatggctcttttgagaataggacactgctgtctttctgttccctttccctcccccatctaggttcacaccctctgatagaatttaatgaactaataggctactaaacattacatctgatgcccccccctgaaaaaatgcagatcctcccattaaaatatgtgtcttcctaaaagtctggccacatcaccatttgagcagttttaagatatgagaactggagataggtgagtggcttactgtcctggtgtctattttagctgacagtttgtctcttgttttatgtcatgtgtagggaattccaaacgaaagctggagaataacaaagataaatgaacgctatgaactttgtgacacatatcctgccctcttggttgtgccagcaaacattcctgatgaggagctaaaaagagtagcatctttcaggtcacggggccggatcccggtaagtaggctgagtgccttgagactctgtaggtacatttcagtacaggatgataatggccatagcatttatatgaggatatcagagactaaattaaactgtaaagttgaaacagagttgcctagttcctaactcaacatttgccctgtgtgttggttattctttatcttatatattctttagtcatggcaataaatgcttttttcttactgagtcaaagagtagaagactacaaattgatgatgtatgtatgactgtgtctcaaaagagcagatgaaataattttagaggcagaagcgtagaatccgagtcctttatagttttactgatatagtaataaaaaaaaacaagtggagtttgtttagctgttttattgtactttttctaagaaaagatttttcaataataagttttacaacagtatctaatttggaagtaggcaattctctacaaaacagttgactagaaagtatggtggcatattttcctggcatccagggccctcggcctgttctgccagaagtctgctctctaggagacttacaagcaggatagcaatatcaccatgttcctgtcattaaggttttatcatggattcatcctgaaagtcaagccacagtcactcgctgcagtcagcccatggtgggagtgagtgggaaacgcagcaaagaggatgagaagtaccttcaggccatcatggactccaatgcccagtctcacaaaatatttatatttgatgctcggccaagtgtcaatgctgttgccaataaggtgagggttgttttgttttttatttttagtaattatttgtcactctggtgttgctaaagccagctagatttgtctgtgctgttgcctggtaaaaagtggtcagaccctatggaggcagagagaggtcagactacactgaggaaatgatgatgatgatttccaagactgcatttcatttgtattatagaaaaattagttcatgcatttagctaagtagatgaagaaaatgttttaaaatgccccaaaacttggaacatcattaagttttgcttgtatttccaggcatatgtagttttctgtaaatatttgaagtgaaatggaataatttttgtaagttaacacattttatgtcactgaaaacttataatggtttcttaatgtctgataataatcacagtaaacattagactttttttgtcctcccattgtgagaggtgcttgagtgaccatccttaactcatggaggatatttctcattctgcatctgcatagtttgtttaaggccattgtgaactccaggtgtcctttgcaaatggcccttttaaaggaggtgagggaggaccatgatatcttaagtcattgcagtggtaaagcatagttgttggtttggttttttgttgttgttgttttttatcatttcttttttgtcagttaaactgatacccttcattggggtaaaaactacaaccaagttcattataaaagattttgtaatgcagaattgtttcattcaattagtattaaataatttgaatgctcaaaattacaggcagttttcaaaagcagactcacatcattgtgaacatcaaacaggcaccatccacagacatgttttatcataattttacattatactgtttaacacactgctcatcaccaatagtctttcttctttatgttattcttcttgatattttactgagtgtgatgcataaataaagcctgtaaccaggaagtcagatgttttctccaccaagtgctgattttcctccctaaattctgaccatgaataaaagtaaaaatcagacttagtcatctgtgagaaggaaaggcagcaactgtggtagggcaaagtgttgatgtcgtcaactctccctcctctacacctcattctggaaatctgcagcaagtataggaggagcagttttcacaccttgatgaattactgttgtaactgctcctgtggccaggatcccactgagccacctgtaccctaagggcagtcactttcttgctctgcactcctcacacatctttatgtatttcacaggtgtttacctctgcactctgcatgtcagctcatcttccagaatattttgttcagtgtcttaggattttgatctgtggtctccttttgcctatccagcttttcctttcatgtcacctgactctgtcacagtgtgggctgtttttattttgttcccaaatctctgaggtgaacgtgaggtttattcagatttaggttccatttgttctgtgggccactgctgactgttgaatctgttactttgattcacttgagctaaaatagtactttttaaaggtactgattgaattctttttgtaaagtgatgcttctcttacctttgattaatcaggataaatgcttcttaattctcagacatgagaggggctgcacaggtaggaatttatagagattagatagtgttggttgttttacacctactttaggccttagcacttggctatcaggatggaagggcccctcttagcttagggtgcatagcctctcactgtggagacaaggctagactgaaacgtgaagagatctgcctgcctctgcctggtgagttctgggtggggctaaaggttgagcctctgtggtaaggttactatacttctaagattaaagaagaaatgtgactttgtggacattcttctgactaaggtcatctgtgaccattgcagtctggtgccttccattcactgatggcagtcaacctttgggactattggtagtctgccctgtgcttgcctatacttggtagtttgagactcagtagagtagttaattaccaagtttagttttaaatgcttttcatcttttgctttactatctagttgctgtttaaaaaaaaaatacttaacggagatataactcagtgtactataagaaagtatccgttcctttagtgtattcacagcccatcgtagctatgagttctgtattatttccatcctcgttctgtagtgggtttctagagtaggtactgccatgctgtgggttgtagtatttcttcctgtttctgtgatgggctattgtagtagctactattaccatctcctgaaattcgttgcaacgaaattgctttgaaaatttctctatcctcaatcttacagttactttgttagttactttttatatcctggggcagaacagctgacaggactgctgtgagcatgtgccagttactcgctgaggcatgctgggagaaacctacgtcttctagctaggcctcacattgtaaacatctcccaacaatctccctaatagtactagcaactagggaccaagtatacaatataagcccatgggtgacatatgttcaaactataacacccattttcactcttcagaagtcatctttgttaacaagtattaccaacatttacttttgtaataatgttgaatacaaattactccatggactagaaatccgacaattttttaaattagtttggagttgaattcagaggtatcatagtcacgatcctattagtggagttgctctactgtactcccaatttgctttttgataaggcttcaagaagtgtgattttatgtatgagttaggcaagacagaagatttttttatgtactatatgtgaaacattctgatactgtcaacagatatgaagacatcaaaaatatagcttcccccatgggagtaggagctatgtaggttttgtataggcctatccctcaactaatcttcaccacatggcagagattatcttcatcctttttccagagcagtacctgtcatctcaagagcttctgaggatgtcctggcattttctaaatgtaaatccatcttcattgctttacggtttgacagaagatttttttaaacataaaatctaatattaaacttgggaaaattatgttctatttttcagctatagcttgtttggaaaagcatgcattttcttattttatagatttgaggatagtaaatgtcagtgggattctctgtttgtatgttaaatttaaaatgaatcagctgcttataatataagcaaactgaaagttaatcttgtcagtttgattgaaaagaggactattgtttctgtgagggcattttgagagataaaagctctgacctgcccaatgggttaatccatttttttatttacattttagattttgcaaagtttagtatatagcaggtagagcttagctgggagaaggggactacttggggtatacctttgagcggtggccttctgcccttcttgctactcttccctgtagcctggctgatatgtgtgaatgattttcctttgccatgttctttctccatgatgaacacactccagaaatgtggggcctacctgtggactgaaacctgtggaactgactgtgaagtaaatctccccaggaaatccttcctcaagtattggttcacagcaacagaactctaacttggagatcattatggctacaatgaatttgtttttctattattaactgaaatgatatgaaaaggaaaataagcttgggtggtctagaatgggactcttgcatgcagaaatgataatttgattatttcagtatgtttgaagggaagtctacataagaagttatagataggatttgatacacacaggaaaagttttctttacaatgctgaagtgctttgaaatgattcagaataaacaaactgatcacataggcttagcacagactccattttagaaatggtatgagtgtgtgtttattacaagtgaccctgagctactcctgctatccttatcctcagcaatgtccatcctattttagatagtttatggaactttgtaatggatgtcttcaaaagatggctactcattcatttatgattttctgtgatttgtgccctttagcaggcaaaagggggaggttatgaaagtgaagatgcctatcaaaatgcagaacttgtttttttggatattcacaatattcatgttatgagagaatcattacgaaagcttaaggagattgtgtaccccaacattgaggaaactcactggttgtctaatttggaatctacacactggctggaacacattaaggtgtgtatttgctactccttctcaaagcctccactcctttgcttgccttggctcttgtaactgaaatcagcaggaaggacctgctgagtagtggagccagtggctctgtgcacactcgggtctgaaggagctgcatcctatgctgtgcatgggtttctgctgcctcttgttttcctcttccatctgaattctgtccatactcaagagacagtgtctttcacttctgacagtcttcgcacattgtatccatttccagtctcttaggttctcaacccctactcaacttatatgccattcttcatttatttgactgtttttgaaacaagttctcactctgaagtccaagcagccctccacctgtgactcctgggattataggcatgacccttggcatctgcatcctttttattgttgattgatgcttcttgccatgtgactgaggtagtttttttttttttggggggggggttcgagacagagtttctcgtgtagctttggagcctatcctggctctggctctgtagaccaggctggcctctgcctcctgagtgctgggattaaaggcatgtgccacctacacctggctgaggcagttctatgtaacagaactatattagtttcttttaagacgtgtttaacattttttattagactttcattttacaccttgtttccagctcattcttgcaggggctcttaggattgctgacaaggtagaatcagggaagacatctgtagtggtacactgcagtgatggctgggatcgcacagctcagctcacttccctggccatgctcatgctagacggatactatcgaacaattcgaggatttgaagtcctcgtggagaaagagtggctaagctttggacatcgattccaactagtaagtaaagaaccttcattttatcatgtgctcatgtgggcatgtacatttgtgtgcaggctaggggttgttggttttcttcctcagttactatctaccttactatttagagacacacggtccttcactgaacccagagttcacagctagccagcaaaactaagagatctgccatttctgcctgtccatgctaggactataggtatgcatattatgcctaacttttacttaggtgttgggaccaaactcagatcttggtgtttttgtggtaaatactcagattttggtgtttttgtagtaaatacttaatgatctatccagcacattcatttttaatgtttcacaaacatcttgtacgagagagaaaaaattggccatttatttagcagagtgaagtcatgagagcactgtatttggtaaagtgttagtatattcttaatgtattgccatctgaacccaggttggtttaggcatatgaccttgtctcttctgtggtttctacctagaaattcagctgttactaatggccatggtgctgtccctccaaatggagcataaagtattgctagctttccctttggccttgaatgaaaaggacagtggttcagttactaattcagttacatataatgttgctaatgtagttcagggtctaaaaaattattaactaaaataatagagtaaaaaaatctggggtttcaatggtcaagaacatttgctcttgtggagggtttgagctcgtttcccagggctcagattaggcagcttccaagcgcttgtaacgagagctagaggatttggcactagccttttggtgtcagtcttcatgtgcacatactcatgtacatagaaataaaaattgaacatctttagactaaaatctacctccctagttattctttccataaatttggaaagttttacagattctcttaaggaaattgcaaaattttgagccctgtgttgttccaagttttttatttagaacttctggttaaacacagggatgtatacaacctagagaagcactctaccactttaaaagaaagagaagttttattttgagacatgggatcttgccaagtttccaaggctgacccctaaatgcagcttacagttccacttgtgatcttctagcctcagtgtctgagcaactagagttttctgtctgtcccactgggactggttttttgttgttttttgttttgtgtatttctaaattaggtggtgctgaaaacgtgttgttagttggattaaaatgtttatccatgaattcaaagtatatacctaaaacatctaagttgtacctacaaaattagtgtttagattcatgtccagaaataagcatacaccccttcttgaggccagcagtcccacttaagactcctgctggaatttccttgtgataatgaaatgaagtttcctgcttcctattgttccaaccctccctctggagacaaatgaaaagtgttccttttatttttcagatatttgaccatagctgtctccccacatcacccataagcttcagcttttccgaatgaacatccttgatgggctttgtctccccatcccagttgtccaccagtattactaatggctctctacaagtgtggtacccatagcttctctcagttctttagtgaaatggaattatgtcctccttgaaaagagaaaacataattgcctttgcttccttgtactatgctttggactcagggcattcttcagtgggatgttaaatctgctcaaggctgtattggaatcaggaaacatgggaacactttaccttgtggatctctgtcttcctcatgttatccatctgtgttattgtattggaatcagagtgaacactggggtcctgttcccaggaaggagaagtaggataagcagatgtctgggttaagaatgagtaataaccaaggcaggaatctggagtctagaggagggagaagccagagcattagaggcctggaaggcactgaggagatgggtcctggcatctgcataggtgctctttaatattattagtctttccttcgaaacactgtttactagcagtgtttataggtaattttaaagaactagaacttgaaattggttgcctctttttgaatgtcaactgtcaagcaaaactaggcagctgaggcatctccctcagtgcctcacactttcccattttttaagaaattaaaaaaatttcttccttaaaagtgtcatgtgttgctggggcagtggtggcgcgcgcctttaatcccagcactcagaggcagaggcaggtggatctctgagtttgaggccagcctggtctacagagtgagttccaggatgccaggactatttcacagagaaaccctgtttcaacccccccccccaaaaaaaatgtcatgtgtttcaaaaccataaactccttgattgcttgctctggtcacccattttccattctttctagttgcactattaatgggctcctttttcttttttaaaataaaaaccagtcaagaaggcatgctactgacaatctgttgaagtttatgaggaaaaccttatgtaggtagtctcataggagcccatttagagaattatggttgttttgaaatctgttaaaatgtagcaaataataagtttgttgtagaatccagaaaaagacaaaacaaaacatatctttgtcttgtctcccctgaattcttttagtctcctacattttctatagttttttgtaacagtatatattggttatgtgaaacacactaactcatgattatacagagcctcctgatttattgtttcattctactgattcagaggcatatgtatgtggttttatcagataagtggataaggcaaaagtttactgaaactctgatcttcaaattattagcaccaaatactatccatagtcttttacattaaggaaaacaaactgtatatttttgaaaaaaatccatcacatattcaagtcttatgagagccatagttaacattaaaatgttatatccttccattctgatgcataggataatcgaaaattgtataccttttccattttgtcatgagattaaaatgtttactcatagataagacttgttaatttttcttgctttgccaataataccctctaagaaaacttgattttctaccttcagttgtgagcatctggcaggatagaatacatacagtctactgtggcccatcaccacagcctagcttgacaaccaacagcagtatgcatttgcacgagtaccagtgctactcactgggaaaggtgaaccaaaacaacatcttagcagtatgactgtattttttttttttttttacatggaaacctgccccagaacttttatgccccactttttaaatgaatccctgctttgggatttttcagttgcatggttgggaacccatttgtgtgaaaaacagatccaagtacttctgaaagatcttgagatttgtgctaatgtagctatcttcttaggaggtgctttttgtcccagtgacctttcataacgaatatcttgtcataggaagttaaatctctagaacaaaactctgggctctaaggctcctctgttgttttagaatctgggtttcatttaagtagcaatgtgacagttttgaggaaattaaaaatactgaccaaattatacttttagaaaataagattctactaagtaaaatatcttacatgtgacatttcattctttgcttcagagagttggccatggagataagaaccatgcagatgcagacagatcacctgttttccttcaatttattgactgtgtctggcagatgacaagacaggtaacgcatcatctattaatacccttctcacacatctctaagctcaaagtggggaaacttgatcactgtttggcttgtgattcttgggtagaattcccagtgataacagctgttactgttgggcattaaaactttttagaagttttaatatgaataaagagcttgatactagtagcatcgcaaccaggggaactgataaaaatgaagattcctcctgtataataatagtcctttgctcactgaaagctctgtatactttgctaaggaagatgaagaaacgagctacattgattccagtcggaaccagacactattttgagtccttttagctgttttaaagaaagaagtatttggacagagtatcaaggcagcgatcacttggccccttctcaatgtggagctgttagaaccctgtaacagcctttgaagtagttgggtaaactgaccagtcttgaaaggtactagaagataacacttggttttacaataggaaacggggctgcagggtcttgaaaatggtttcaggagtagggttaagcctgaaggcatagttcttgttactggagacataccagtaagataaataaggcaagaatttgacccagctgtctgattggtaggatccaccaaggtcactaggtataacctgggagctgtgactgactagagtgctgtttgggtaggatggggagacattttttagaaatttaattctaaactaagaagggggaaaaaaaaaaccagaagttgaaagttaatttaatcagcattttaattacttagcaaaacaagcattagcagtaaactacatgtctccatagattttagttgacaggaactttttctaaaataccaagacagtattttccaggttgttgtggaatttttcacaaactattcagatttacaagtatgtttctgaatgattttgaaataataacagggtggattaaattaagccttttactaccttttggtggtctgtaatttaattcttcctttggtcctccaaaattggattgtataaaattaagatacccactgaagcttgtataggggtgaattctgtgttggactgatgttgccaattgtgaattacaaggacctgttcttcaacaagataaataggttgacttgtaagttgactgcatagctgcacagttacttacttctgtgtatatagtgatggcatttgccaaacacatttgttatttttaattcttagaaataagatgtgatgaaaactaataaacatggaagaccagactcatcagaattgctccaagtcataagtcagtggctggcaactatagggtcaaggcagagcagacacaaaaccagcattaagtccactcaatacttgctgcatgagagaaactctaccttgcaaaggaaaacatgccacaaatgcttaggtagtttcaaatctgtctaagtattattacagaggatctactcacgacagggataattatccctgaaaaatgtcttaaatttgtgtgctcaattttgcagttccctactgcgtttgaattcaatgaatatttcctcattaccatcctggaccacttgtacagctgtttatttgggacattcctctgtaacagcgaacagcagagggggaaggaggtaaggtatagctctggctcttactctggtatttggttttttgtatctcacaagatatactagtatatacttccatccgtgaagtgtgggggtgagaaaatcacacctataatcccagatactccagagggtaaggtagaaggatcacaaatctgaggccagcctttttaaacagatcccatctcaaaagacgtctgaagaaaagaggatgctggagatgtagagttcagtgatggactgcttgcctagtgctgtgaagtgctgggttcaatcctgctacaacaaaaacaaacaaaagaaccactctgtagaagcatcactgttggtggtactggtagttccctccatgcacatcaatgttcatcctaaaaactgtcagaaaataagggtactcacactgaaaagccttgctaccaggttcagatgttactcactaatatgcatgttcattcttatttctgtaaagcaggcaagtagatgaaaattaagtgcttcttagactgtactttgcaggtattgtatcttacagtgaatgtatttctgtgcatggtaggctttccatatgttacgtggtactagataatcaccaatagagcactgcagtgttctaattactatcacttttgagaaacccccttgatttaagtcttagctgtaatttaaataccataagccctcttttaaagtggtaatttaatggtatagccacagaattggaaccatcaaaatttagagcattttcatcacaccagtcacccatacctgtctatccacattctctcaggtttgggtagatactaacctggtttctcaggaattatgcactgtcattcaccatgtgaaatttgtgtctagctccttgcattatcttttcaacatttatgtcatagtactttcttttcttcatggtcaaataatcttccattgtctcaaatcaatcttcctttgggttctttattttggttgttgtgaatagtattgctttaaacatatggagcacttttattttttgtgtatgggcatgtgtgtttgtgcatgggagaccagagaggatattagatgccctgcagctaatgttttgagctacccaatgtggataaattttgatcctatctccagcactgaggcactttatgtaccagtgtttttcaatctgcaaatacaactgttgggcatttcatgttaactgtgttcatttccatcaaagtaggtctattagcagttagtttcctctattgttgactttaataatcacacagtacacaagtactgctgatgtggtggggaatctttaccagttttttcctcttgcagaatcttcctaagaggacagtgtcattatggtcctacataaacagccagctggaagatttcaccaatcctctctatggaagctactccaatcatgtcctttacccagtagccagcatgcgccaccttgaactctgggtaggatattacataaggtggaacccccgaatgaaaccacaggtacagatctacaatatacagtataactctactaggtctgtcacactctctctgtccattagtaattacaatccacagagtcacagaagcactgcataagacaggagactttcccaagtgcacacatcctgaagaaaataactttataaaagcctaaaaacagcaggtccacagttctgaagagttttagctagatgatgtatttgtaaagtagcatcttccagaaacgtaaagacattgaaagatcagtgatgacaataaaaccttgctttaattccactgaggaactcggtgtcacaaagccagacgaatggttaagatcttgtttggctgggattcctattacagtaattttgtttgctcttgcaggaacccatccacaacagatacaaagaacttcttgccaaaagagcagagcttcagagaaaagtagaagaacttcaaagagaaatttccaaccgctcaacctcctcctcagagagagccagctctcctgcacagtgtgtgactcctgttcaaactgttgtatgaaaggactattaggtcaagggcctcactgccaggaacttgacattacagcaccttacgggtagaaagccttccatgtttttaaacccatctatgggagaaaccttcagatgctgtatttatttcaagtctctcttagatgagtttggaaatgtctggtgcaggtgacaatggaaatcatttcatttgtaattaaagtatgacactaacttaagtcacccaaagaatactaaagtactggagtcctatttccacagtggggacacgtttttaattttaaaatgtcttaaaaaccaagcacctggtaagatctctaggtgggagaaaagaaagagcagctgttctaatacccaagagcatatgtctgggccttcatgtaaatgtcagatcaaattactcccttctcagatttctcaatttttgtggtatttaacagtaaaaaccattgttttgagattattactgcatatcaatagttaaaaattgctgctgacattgtaactagggtattttcaacagcagttaggaaatgatgccttatatatgtgctttggggggatgaggggacaaagcagtatctgtcatccaggaattcaaagaacattccacacccttcagactaatttacatttgtgtgttaatcgctaacatcacagaagacattttagaaactattactctattttatcttagtgataattggcaagttttaaagtctgactttagtgctatgtttaaatttcacatgaacagtttaccaaagaacacactgcatgtaaggaattacaatctaagtgccagcaagtaaagccttgtttctctattcacctgagttgggtgctggtgtgaacaactgacctcctggtatccattttactctgtataagagccatatgtaatgtactgtaacaaaggagcttattaccacttggtcttttaattaaatgacttcaaactttg

SEQ ID NO: 7 - DNA, 2317 bp, Cricetulus griseus
tctttggttcagtgcggtggcagcggcggcggcggcagtggctgctgtggtgaaggaggaggaggagccgagcgggcgttggtaccaaggcctgaccatggacgaggaatacgatgtgatagtactggggacaggtcttaccgaatgcatcttgtctggcatcatgtctgtgaatggaaagaaggtgctgcacatggaccggaacccttactatgggggtgagagctcttccatcacacccctggaagagctatataaacgttttcagttgctggaagggccccctgagtcaatgggccggggccgagactggaatgttgacttgatccccaaatttctcatggccaatggtcagctggtaaagatgctgctgtatacagaagtgactcgttatctggacttcaaggtggttgagggcagctttgtatacaagggaggcaagatctacaaagtaccatccactgagactgaggccttggcttctaatctgatgggcatgtttgaaaaacgacgcttccggaaattcttggtgtttgtggcaaactttgatgagaatgaccccaaaacctttgagggtgtcgacccccagaccaccagcatgcgtgatgtctacaggaagtttgatctgggccaagatgtcattgatttcactggccatgccttggcgctctaccgcactgatgactacctggatcagccctgtcttgagactattaaccgtatcaagttgtacagtgaggtcctggccaggtctggcaagagcccatatttgtacccactctatggcctgggcgagctgccccagggctttgcaagattgagtgccatatatgggggaacatatatgctgaacaaacctgtggatgaaatcatcatggagaatggcaaggtggtgggtgtgaaatctgagggagaggtggcccgctgtaagcagctgatctgtgaccctagctacatcccagaccgtgtacggaaggctggccaggttattcgtatcatctgtatcctcagccaccccatcaagaacaccaatgatgccaattcttgccaaattatcatccctcagaaccaggtcaacaggaagtcagacatctatgtgtgcatgatctcctatgcacacaacgtggcagcacagggcaaatacatcgccattgccagcaccaccgtggagactgcagaaccggaaaaggaggttgagcctgcattggagctgttggaacccattgaccagaagtttgtggctatcagtgatttgtatgagcctattgatgatggttctgagagtcaggtgttttgttcgtgctcctatgatgccaccacacactttgagactacttgcaatgacatcaaagatatctacaaacgcatggctgggtctgcctttgattttgagaacatgaagcgcaaacagaatgatgtctttggagaggctgatcagtgattgctgactcccctcctccagcccctgctcccctttccccaacctgtatgtcctttggggcagggaagatggtatggctgggtatccctgtttccagcatcttctgtttcccccaccacattctgatcacttaccttgttgatttgattcactgaccaaatccttaaccttagtgatggtttgggagatgggggttgggtagtatcctctttcttggttctaggaaaagaggattcctgtgtgtgagcacatgtgctcacgagtgtgtgagtgtgtgtgtgtgtgtgtgtgtgtgtgtgtgtgtgtgtgtgtgtgtgtatacacgtgtacaccctaattctgctgtttgggaaggagtggaggaaaagctgactctgcccccactgttcttactcctaatgtagtggcctttggagataccccatctccacccccaactcttatgtgttggagagaaggggccctcccagcacaaaattgcattcctcttcccccttataatttattctaatttattaactttgacctatctgtctgagccttcagcctttctgtgcagcctggggctgtagagttagctgccctggcctttcccatccctggcaaagtctgggttgggtgaaggtttatgtgtggccccctttgggagttgatctatttttaatttcttgtctttgtgttgtgttctttgagaaaacgtaaatgtgagcaaagcagaaggaggtgggaaagtggatccaaaccccagtgtgccctgcccaatgccttttcctttagtggttggaaacccttatcttgcaaagtgaatgtgtccccttccccaacctctagtgtatttcaaaataaaacccctccaataaaactgttgaaacctga

What is claimed is:

1. A targeted integration (TI) host cell comprising an exogenous nucleotide sequence integrated at an integration site within a specific locus of the genome of the host cell, wherein the locus is at least about 90% homologous to a sequence selected from: contig NW_006874047.1 (SEQ ID NO: 8); contig NW_006884592.1 (SEQ ID NO: 9), contig NW_006881296.1 (SEQ ID NO: 10), contig NW_003616412.1 (SEQ ID NO: 11), contig NW 003615063.1 (SEQ ID NO: 12), contig NW_006882936.1 (SEQ ID NO: 13), and contig NW_003615411.1 (SEQ ID NO: 14).

2. The TI host cell of claim 1, wherein the nucleotide sequence immediately 5' of the integrated exogenous nucleotide sequence is selected from the group consisting of:
    (a) sequences at least about 90% homologous to nucleotides 41190-45269 of NW_006874047.1 (SEQ ID NO: 8), nucleotides 63590-207911 of NW_006884592.1 (SEQ ID NO: 9), nucleotides 253831-491909 of NW 006881296.1 (SEQ ID NO: 10), nucleotides 69303-79768 of NW 003616412.1 (SEQ ID NO: 11), nucleotides 293481-315265 of NW_003615063.1 (SEQ ID NO: 12), nucleotides 2650443-2662054 of NW_006882936.1 (SEQ ID NO: 13), and nucleotides 82214-97705 of NW 003615411.1 (SEQ ID NO: 14); or
    (b) sequences within 3,000 base pairs from nucleotide 45269 of NW 006874047.1 (SEQ ID NO: 8), nucleotide 207911 of NW 006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW_006882936.1 (SEQ ID NO: 13), and nucleotide 97705 of NW 003615411.1 (SEQ ID NO: 14).

3. The TI host cell of claim 2, wherein the nucleotide sequence immediately 5' of the integrated exogenous nucleotide sequence is within 2,000 base pairs from nucleotide 45269 of NW 006874047.1 (SEQ ID NO: 8), nucleotide 207911 of NW 006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

4. The TI host cell of claim 2, wherein the nucleotide sequence immediately 5' of the integrated exogenous nucleotide sequence is within 1,000 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

5. The TI host cell of claim 2, wherein the nucleotide sequence immediately 5' of the integrated exogenous nucleotide sequence is within 500 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

6. The TI host cell of claim 2, wherein the nucleotide sequence immediately 5' of the integrated exogenous nucleotide sequence is within 200 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

7. The TI host cell of claim 2, wherein the nucleotide sequence immediately 5' of the integrated exogenous nucleotide sequence is within 100 base pairs from nucleotide 45269 of NW_006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

8. The TI host cell of claim 2, wherein the nucleotide sequence immediately 5' of the integrated exogenous nucleotide sequence is within 50 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

9. The TI host cell of claim 2, wherein the nucleotide sequence immediately 5' of the integrated exogenous nucleotide sequence is within 20 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

10. The TI host cell of claim 1, wherein the nucleotide sequence immediately 3' of the integrated exogenous nucleotide sequence is selected from the group consisting of:
  (a) sequences at least about 90% homologous to nucleotides 45270-45490 of NW_006874047.1 (SEQ ID NO: 8), nucleotides 207912-792374 of NW 006884592.1 (SEQ ID NO: 9), nucleotides 491910-667813 of NW 006881296.1 (SEQ ID NO: 10), nucleotides 79769-100059 of NW 003616412.1 (SEQ ID NO: 11), nucleotides 315266-362442 of NW_003615063.1 (SEQ ID NO: 12), nucleotides 2662055-2701768 of NW_006882936.1 (SEQ ID NO: 13), and nucleotides 97706-105117 of NW 003615411.1 (SEQ ID NO: 14); or
  (b) sequences within 3,000 base pairs from nucleotide 45270 of NW_006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), and nucleotide 97706 of NW_003615411.1 (SEQ ID NO: 14).

11. The TI host cell of claim 10, wherein the nucleotide sequence immediately 3' of the integrated exogenous nucleotide sequence is within 2,000 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

12. The TI host cell of claim 10, wherein the nucleotide sequence immediately 3' of the integrated exogenous nucleotide sequence is within 1,000 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

13. The TI host cell of claim 10, wherein the nucleotide sequence immediately 3' of the integrated exogenous nucleotide sequence is within 500 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW 006882936.1 (SEQ ID NO: 13), or nucleotide 97706 of NW 003615411.1 (SEQ ID NO: 14).

14. The TI host cell of claim 10, wherein the nucleotide sequence immediately 3' of the integrated exogenous nucleotide sequence is within 200 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

15. The TI host cell of claim 10, wherein the nucleotide sequence immediately 3' of the integrated exogenous nucleotide sequence is within 100 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW 003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

16. The TI host cell of claim 10, wherein the nucleotide sequence immediately 3' of the integrated exogenous nucleotide sequence is within 50 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

17. The TI host cell of claim 10, wherein the nucleotide sequence immediately 3' of the integrated exogenous nucleotide sequence is within 20 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

18. The TI host cell of claim 1, wherein the TI host cell is a mammalian host cell.

19. The TI host cell of claim 1, wherein the TI host cell is a hamster host cell, a human host cell, a rat host cell, or a mouse host cell.

20. The TI host cell of claim 1, wherein the exogenous nucleotide sequence comprises one or more recombination recognition sequences (RRSs), wherein the RRS can be recognized by a recombinase.

21. The TI host cell of claim 20, wherein the exogenous nucleotide sequence comprises at least two RRSs.

22. The TI host cell of claim 21, wherein the exogenous nucleotide sequence comprises a first and a second RRS, and at least one selection marker located between the first and the second RRS.

23. The TI host cell of claim 22, further comprising a second selection marker, wherein the first and the second selection markers are different.

24. The TI host cell of claim 23, further comprising a third selection marker and an internal ribosome entry site (IRES), wherein the IRES is operably linked to the third selection marker.

25. The TI host cell of claim 22, further comprising a third RRS, wherein the third RRS is located between the first and the second RRS, and the third RRS is heterospecific relative the first or the second RRS.

26. The TI host cell of claim 25, wherein the exogenous nucleotide sequence further comprises at least one exogenous SOI located between the first and the third RRS, and at least one exogenous SOI located between the third and the second RRS.

27. The TI host cell of claim 26, wherein the SOI encodes a single chain antibody, an antibody light chain, an antibody heavy chain, a single-chain Fv fragment (scFv), or an Fc fusion protein.

28. The TI host cell of claim 20, wherein the recombinase is a Cre recombinase, an FLP recombinase, a Bxb1 integrase or a φC31 integrase.

29. The TI host cell of claim 20, wherein the exogenous nucleotide sequence comprises at least one selection marker and at least one exogenous sequence of interest (SOI).

30. The TI host cell claim 20, wherein the exogenous nucleotide sequence further comprises at least one exogenous SOI.

31. The TI host cell of claim 30, wherein the exogenous SOI is located between a first RRS and a second RRS.

32. The TI host cell of claim 30, wherein the SOI encodes a single chain antibody, an antibody light chain, an antibody heavy chain, a single-chain Fv fragment (scFv), or an Fc fusion protein.

33. A method of preparing a TI host cell expressing a polypeptide of interest comprising:
  a) providing a TI host cell comprising an exogenous nucleotide sequence integrated at a site within a locus of the genome of the TI host cell, wherein the locus is at least about 90% homologous to a sequence selected from contig NW_006874047.1 (SEQ ID NO: 8), contig NW 006884592.1 (SEQ ID NO: 9), contig NW_006881296.1 (SEQ ID NO: 10), contig NW_003616412.1 (SEQ ID NO: 11), contig NW 003615063.1 (SEQ ID NO: 12), contig NW_006882936.1 (SEQ ID NO: 13), and contig NW_003615411.1 (SEQ ID NO: 14), wherein the exogenous nucleotide sequence comprises two RRSs, flanking at least one first selection marker;
  b) introducing into the cell provided in a) a vector comprising two RRSs matching the two RRSs on the integrated exogenous nucleotide sequence and flanking at least one exogenous SOI and at least one second selection marker;
  c) introducing a recombinase or a nucleic acid encoding a recombinase, wherein the recombinase recognizes the RRSs; and
  d) selecting for TI cells expressing the second selection marker to thereby isolate a TI host cell expressing the polypeptide.

34. The method of claim 33, wherein the nucleotide sequence immediately 5' of the integrated exogenous nucleotide sequence is within 3,000 base pairs from nucleotide 45269 of NW 006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

35. The method of claim 34, wherein the nucleotide sequence immediately 5' of the integrated exogenous nucleotide sequence is within 2,000 base pairs from nucleotide 45269 of NW_006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

36. The method of claim 34, wherein the nucleotide sequence immediately 5' of the integrated exogenous nucleotide sequence is within 1,000 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

37. The method of claim 34, wherein the nucleotide sequence immediately 5' of the integrated exogenous nucleotide sequence is within 500 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

38. The method of claim 34, wherein the nucleotide sequence immediately 5' of the integrated exogenous nucleotide sequence is within 200 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW 006882936.1 (SEQ ID NO: 13), or nucleotide 97705 of NW 003615411.1 (SEQ ID NO: 14).

39. The method of claim 34, wherein the nucleotide sequence immediately 5' of the integrated exogenous nucleotide sequence is within 100 base pairs from nucleotide 45269 of NW 006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

40. The method of claim 34, wherein the nucleotide sequence immediately 5' of the integrated exogenous nucleotide sequence is within 50 base pairs from nucleotide 45269 of NW 006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW 003615063.1 (SEQ ID NO: 12), nucleotide 2662054 of NW 006882936.1 (SEQ ID NO: 13), or nucleotide 97705 of NW 003615411.1 (SEQ ID NO: 14).

41. The method of claim 34, wherein the nucleotide sequence immediately 5' of the integrated exogenous nucleotide sequence is within 20 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW 003615063.1 (SEQ ID NO: 12), nucleotide 2662054 of NW 006882936.1 (SEQ ID NO: 13), or nucleotide 97705 of NW 003615411.1 (SEQ ID NO: 14).

42. The method of claim 33, wherein the nucleotide sequence immediately 3' of the integrated exogenous nucleotide sequence is within 3,000 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW 003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

43. The method of claim 42, wherein the nucleotide sequence immediately 3' of the integrated exogenous nucleotide sequence is within 2,000 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW 006882936.1 (SEQ ID NO: 13), or nucleotide 97706 of NW_003615411.1 (SEQ ID NO: 14).

44. The method of claim 43, wherein the nucleotide sequence immediately 3' of the integrated exogenous nucleotide sequence is within 200 base pairs from nucleotide 45270 of NW_006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW 006882936.1 (SEQ ID NO: 13), or nucleotide 97706 of NW 003615411.1 (SEQ ID NO: 14).

45. The method of claim 43, wherein the nucleotide sequence immediately 3' of the integrated exogenous nucleotide sequence is within 100 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

46. The method of claim 43, wherein the nucleotide sequence immediately 3' of the integrated exogenous nucleotide sequence is within 50 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

47. The method of claim 43, wherein the nucleotide sequence immediately 3' of the integrated exogenous nucleotide sequence is within 20 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW 006882936.1 (SEQ ID NO: 13), or nucleotide 97706 of NW 003615411.1 (SEQ ID NO: 14).

48. The method of claim 42, wherein the nucleotide sequence immediately 3' of the integrated exogenous nucleotide sequence is within 1,000 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

49. The method of claim 42, wherein the nucleotide sequence immediately 3' of the integrated exogenous nucleotide sequence is within 500 base pairs from nucleotide 45270 of NW_006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW 006882936.1 (SEQ ID NO: 13), or nucleotide 97706 of NW 003615411.1 (SEQ ID NO: 14).

50. A method for expressing a polypeptide of interest comprising:
a) providing a TI host cell comprising at least one exogenous SOI each encoding a polypeptide of interest, and at least one selection marker where the at least one exogenous SOI and at least one selection marker are flanked by two RRSs integrated within a locus of the genome of the TI host cell, wherein the locus is at least about 90% homologous to a sequence selected from: contig NW_006874047.1 (SEQ ID NO: 8), contig NW_006884592.1 (SEQ ID NO: 9), contig NW_006881296.1 (SEQ ID NO: 10), contig NW_003616412.1 (SEQ ID NO: 11), contig NW_003615063.1 (SEQ ID NO: 12), contig NW_006882936.1 (SEQ ID NO: 13), and contig NW_003615411.1 (SEQ ID NO: 14); and
b) culturing the cell in a) under conditions suitable for expressing the polypeptide of interest and recovering a polypeptide of interest therefrom.

51. The method of claim 50, wherein the nucleotide sequence immediately 5' of the integrated exogenous SOI and the at least one selection marker flanked by two RRSs is within 3,000 base pairs from nucleotide 45269 of NW 006874047.1 (SEQ ID NO: 8), nucleotide 207911 of NW 006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW 006882936.1 (SEQ ID NO: 13), or nucleotide 97705 of NW 003615411.1 (SEQ ID NO: 14).

52. The method of claim 51, wherein the nucleotide sequence immediately 5' of the integrated exogenous SOI and the at least one selection marker flanked by two RRSs is within 2,000 base pairs from nucleotide 45269 of NW 006874047.1 (SEQ ID NO: 8), nucleotide 207911 of NW 006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

53. The method of claim 51, wherein the nucleotide sequence immediately 5' of the integrated exogenous SOI and the at least one selection marker flanked by two RRSs is within 1,000 base pairs from nucleotide 45269 of NW_006874047.1 (SEQ ID NO: 8), nucleotide 207911 of NW 006884592.1 (SEQ ID NO: 9), nucleotide 491909 of NW_006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411 (SEQ ID NO: 14).

54. The method of claim 51, wherein the nucleotide sequence immediately 5' of the integrated exogenous SOI and the at least one selection marker flanked by two RRSs is within 500 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411.1 (SEQ ID NO: 14).

55. The method of claim 51, wherein the nucleotide sequence immediately 5' of the integrated exogenous SOI and the at least one selection marker flanked by two RRSs is within 200 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411.1 (SEQ ID NO: 14).

56. The method of claim 51, wherein the nucleotide sequence immediately 5' of the integrated exogenous SOI and the at least one selection marker flanked by two RRSs is within 100 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411.1 (SEQ ID NO: 14).

57. The method of claim 51, wherein the nucleotide sequence immediately 5' of the integrated exogenous SOI and the at least one selection marker flanked by two RRSs is within 50 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411.1 (SEQ ID NO: 14).

58. The method of claim 51, wherein the nucleotide sequence immediately 5' of the integrated exogenous SOI and the at least one selection marker flanked by two RRSs is within 20 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW_003615411.1 (SEQ ID NO: 14).

59. The method of claim 50, wherein the nucleotide sequence immediately 3' of the integrated exogenous SOI and the at least one selection marker flanked by two RRSs is within 3,000 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

60. The method of claim 59, wherein the nucleotide sequence immediately 3' of the integrated exogenous SOI and the at least one selection marker flanked by two RRSs is within 2,000 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

61. The method of claim 59, wherein the nucleotide sequence immediately 3' of the integrated exogenous SOI and the at least one selection marker flanked by two RRSs is within 1,000 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

62. The method of claim 59, wherein the nucleotide sequence immediately 3' of the integrated exogenous SOI and the at least one selection marker flanked by two RRSs is within 500 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

63. The method of claim 59, wherein the nucleotide sequence immediately 3' of the integrated exogenous SOI and the at least one selection marker flanked by two RRSs is within 200 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

64. The method of claim 59, wherein the nucleotide sequence immediately 3' of the integrated exogenous SOI and the at least one selection marker flanked by two RRSs is within 100 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW_003615411.1 (SEQ ID NO: 14).

65. The method of claim 59, wherein the nucleotide sequence immediately 3' of the integrated exogenous SOI and the at least one selection marker flanked by two RRSs is within 50 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

66. The method of claim 59, wherein the nucleotide sequence immediately 3' of the integrated exogenous SOI and the at least one selection marker flanked by two RRSs is within 20 base pairs from nucleotide 45270 of NW 006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

67. A method for expressing two polypeptides of interest comprising:
(a) providing a TI host cell comprising an exogenous nucleotide sequence integrated at a site within a locus of the genome of the host cell, wherein the locus is at least about 90% homologous to a sequence selected from contig NW_006874047.1 (SEQ ID NO: 8), contig NW_006884592.1 (SEQ ID NO: 9), contig NW_006881296.1 (SEQ ID NO: 10), contig NW_003616412.1 (SEQ ID NO: 11), contig NW_003615063.1 (SEQ ID NO: 12), contig NW_006882936.1 (SEQ ID NO: 13), and contig NW_003615411.1 (SEQ ID NO: 14), wherein the exogenous nucleotide sequence comprises a first and a second RRS flanking at least one first selection marker, and a third RRS located between the first and the second RRS, and all the RRSs are heterospecific;
(b) introducing into the cell provided in a) a first vector comprising two RRSs matching the first and the third RRS on the integrated exogenous nucleotide sequence and flanking at least one first exogenous SOI and at least one second selection marker;
(c) introducing into the cell provided in a) a second vector comprising two RRSs matching the second and the third RRS on the integrated exogenous nucleotide sequence and flanking at least one second exogenous SOI;
(d) introducing one or more recombinases, or one or more nucleic acids encoding one or more recombinases, wherein the one or more recombinases recognize the RRSs; and
(e) selecting for TI cells expressing the second selection marker to thereby isolate a TI host cell expressing the first and second polypeptides of interest.

68. The method of claim 67, wherein the nucleotide sequence immediately 5' of the integrated exogenous nucleotide sequence is within 3,000 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW 006882936.1 (SEQ ID NO: 13), and nucleotide 97705 of NW 003615411.1 (SEQ ID NO: 14).

69. The method of claim 68, wherein the nucleotide sequence immediately 5' of the integrated exogenous nucleotide sequence is within 2,000 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

70. The method of claim 68, wherein the nucleotide sequence immediately 5' of the integrated exogenous nucleotide sequence is within 1,000 base pairs from nucleotide 45269 of NW_006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

71. The method of claim 68, wherein the nucleotide sequence immediately 5' of the integrated exogenous nucleotide sequence is within 500 base pairs from nucleotide 45269 of NW 006874047.1 (SEQ ID NO: 8), nucleotide 207911 of NW_006884592.1 (SEQ ID NO: 9), nucleotide 491909 of NW 006881296.1 (SEQ ID NO: 10), nucleotide 79768 of NW 003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

72. The method of claim 68, wherein the nucleotide sequence immediately 5' of the integrated exogenous nucleotide sequence is within 200 base pairs from nucleotide 45269 of NW 006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

73. The method of claim 68, wherein the nucleotide sequence immediately 5' of the integrated exogenous nucleotide sequence is within 100 base pairs from nucleotide 45269 of NW 006874047.1 (SEQ ID NO: 8), nucleotide 207911 of NW 006884592.1 (SEQ ID NO: 9), nucleotide 491909 of NW_006881296.1 (SEQ ID NO: 10), nucleotide 79768 of NW_003616412.1 (SEQ ID NO: 11) , nucleotide 315265 of NW 003615063.1 (SEQ ID NO: 12), nucleotide 2662054 of NW_006882936.1 (SEQ ID NO: 13), or nucleotide 97705 of NW 003615411.1 (SEQ ID NO: 14).

74. The method of claim 68, wherein the nucleotide sequence immediately 5' of the integrated exogenous nucleotide sequence is within 50 base pairs from nucleotide 45269 of NW_006874047.1 (SEQ ID NO: 8), nucleotide 207911 of NW 006884592.1 (SEQ ID NO: 9), nucleotide 491909 of NW 006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

75. The method of claim 68, wherein the nucleotide sequence immediately 5' of the integrated exogenous nucleotide sequence is within 20 base pairs from nucleotide 45269 of NW_006874047.1 (SEQ ID NO: 8), nucleotide 207911 of NW_006884592.1 (SEQ ID NO: 9), nucleotide 491909 of NW_006881296.1 (SEQ ID NO: 10), nucleotide 79768 of NW_003616412.1 (SEQ ID NO: 11), nucleotide 315265 of NW_003615063.1 (SEQ ID NO: 12), nucleotide 2662054 of NW_006882936.1 (SEQ ID NO: 13), or nucleotide 97705 of NW 003615411.1 (SEQ ID NO: 14).

76. The method of claim 67, wherein the nucleotide sequence immediately 3' of the integrated exogenous nucleotide sequence is within 3,000 base pairs from nucleotide 45270 of NW 006874047.1 (SEQ ID NO: 8), nucleotide 207912 of NW 006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

77. The method of claim 76, wherein the nucleotide sequence immediately 3' of the integrated exogenous nucleotide sequence is within 2,000 base pairs from nucleotide 45270 of NW 006874047.1 (SEQ ID NO: 8), nucleotide 207912 of NW 006884592.1 (SEQ ID NO: 9), nucleotide 491910 of NW 006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

78. The method of claim 76, wherein the nucleotide sequence immediately 3' of the integrated exogenous nucleotide sequence is within 1,000 base pairs from nucleotide 45270 of NW 006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW 003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

79. The method of claim 76, wherein the nucleotide sequence immediately 3' of the integrated exogenous nucleotide sequence is within 500 base pairs from nucleotide 45270 of NW 006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

80. The method of claim 76, wherein the nucleotide sequence immediately 3' of the integrated exogenous nucleotide sequence is within 200 base pairs from nucleotide 45270 of NW 006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW 003616412.1 (SEQ ID NO: 11), nucleotide 315266 of NW 003615063.1 (SEQ ID NO: 12), nucleotide 2662055 of NW_006882936.1 (SEQ ID NO: 13), or nucleotide 97706 of NW 003615411.1 (SEQ ID NO: 14).

81. The method of claim 76, wherein the nucleotide sequence immediately 3' of the integrated exogenous nucleotide sequence is within 100 base pairs from nucleotide 45270 of NW_006874047.1, nucleotide 207912 of NW_006884592.1, nucleotide 491910 of 79769 of NW_003616412.1, nucleotide 315266 of NW 006881296.1, nucleotide NW_003615063.1, nucleotide 2662055 of NW_006882936.1, or nucleotide 97706 of NW 003615411.1.

82. The method of claim 76, wherein the nucleotide sequence immediately 3' of the integrated exogenous nucleotide sequence is within 50 base pairs from nucleotide 45270 of NW 006874047.1 (SEQ ID NO: 8), nucleotide 207912 of NW_006884592.1 (SEQ ID NO: 9), nucleotide 491910 of NW 006881296.1 (SEQ ID NO: 10), nucleotide 79769 of NW 003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

83. The method of claim 76, wherein the nucleotide sequence immediately 3' of the integrated exogenous nucleotide sequence is within 20 base pairs from nucleotide 45270 of NW_006874047.1 (SEQ ID NO: 8), nucleotide 207912 of NW_006884592.1 (SEQ ID NO: 9), nucleotide 491910 of NW_006881296.1 (SEQ ID NO: 10), nucleotide 79769 of NW_003616412.1 (SEQ ID NO: 11), nucleotide 315266 of NW_003615063.1 (SEQ ID NO: 12), nucleotide 2662055 of NW_006882936.1 (SEQ ID NO: 13), or nucleotide 97706 of NW 003615411.1 (SEQ ID NO: 14).

84. A vector comprising two nucleotide sequences at least 50% homologous to:
  (a) two reference sequences selected from any portion of contig NW_006874047.1 (SEQ ID NO: 8);
  (b) two reference sequences selected from any portion of contig NW_006884592.1 (SEQ ID NO: 9);
  (c) two reference sequences selected from any portion of contig NW_006881296.1 (SEQ ID NO: 10);
  (d) two reference sequences selected from any portion of contig NW_003616412.1 (SEQ ID NO: 11);
  (e) two reference sequences selected from any portion of contig NW_003615063.1 (SEQ ID NO: 12);
  (f) two reference sequences selected from any portion of contig NW_006882936.1 (SEQ ID NO: 13); or
  (g) two reference sequences selected from any portion of contig NW_003615411.1 (SEQ ID NO: 14),
wherein said sequences flank a DNA cassette, and wherein the DNA cassette comprises at least one selection marker and at least one exogenous SOI flanked by two RRSs.

* * * * *